United States Patent
Rajpal et al.

(10) Patent No.: US 11,072,644 B2
(45) Date of Patent: Jul. 27, 2021

(54) INHIBITORY CHIMERIC ANTIGEN RECEPTORS

(71) Applicants: ALLOGENE THERAPEUTICS, INC., South San Francisco, CA (US); CELLECTIS, Paris (FR)

(72) Inventors: Arvind Rajpal, San Francisco, CA (US); Shobha Chowdary Potluri, Foster City, CA (US); Laurent Poirot, Paris (FR); Alexandre Juillerat, New York, NY (US); Thomas Charles Pertel, San Mateo, CA (US); Donna Marie Stone, Brisbane, CA (US); Barbra Johnson Sasu, San Francisco, CA (US)

(73) Assignees: Allogene Therapeutics, Inc., South San Francisco, CA (US); Cellectis, Paris (FR)

( * ) Notice: Subject to any disclaimer, the term of this patent is extended or adjusted under 35 U.S.C. 154(b) by 211 days.

(21) Appl. No.: 15/525,906

(22) PCT Filed: Nov. 9, 2015

(86) PCT No.: PCT/IB2015/058650
§ 371 (c)(1),
(2) Date: May 10, 2017

(87) PCT Pub. No.: WO2016/075612
PCT Pub. Date: May 19, 2016

(65) Prior Publication Data
US 2018/0044399 A1 Feb. 15, 2018

Related U.S. Application Data

(60) Provisional application No. 62/078,927, filed on Nov. 12, 2014, provisional application No. 62/081,960, filed on Nov. 19, 2014.

(51) Int. Cl.
| | |
|---|---|
| C07K 14/705 | (2006.01) |
| C07K 16/30 | (2006.01) |
| A61K 35/17 | (2015.01) |
| C07K 14/725 | (2006.01) |
| C07K 16/28 | (2006.01) |
| C12N 5/0783 | (2010.01) |
| A61K 39/00 | (2006.01) |

(52) U.S. Cl.
CPC ........ *C07K 14/70503* (2013.01); *A61K 35/17* (2013.01); *C07K 14/7051* (2013.01); *C07K 14/70517* (2013.01); *C07K 14/70521* (2013.01); *C07K 14/70578* (2013.01); *C07K 16/2803* (2013.01); *C07K 16/3069* (2013.01); *C12N 5/0636* (2013.01); *A61K 2039/5156* (2013.01); *C07K 2317/622* (2013.01); *C07K 2317/76* (2013.01); *C07K 2319/03* (2013.01); *C07K 2319/70* (2013.01); *C07K 2319/74* (2013.01); *C12N 2510/00* (2013.01)

(58) Field of Classification Search
CPC ............ A61K 2039/5156; A61K 35/17; C07K 2317/76; C07K 2319/03; C12N 5/0636
USPC ...................................................... 424/133.1
See application file for complete search history.

(56) References Cited

U.S. PATENT DOCUMENTS

| | | | | |
|---|---|---|---|---|
| 9,670,281 | B2 * | 6/2017 | Lim | C07K 16/28 |
| 9,834,608 | B2 * | 12/2017 | Lim | C07K 16/28 |
| 2015/0376296 | A1 * | 12/2015 | Fedorov | A61K 35/17 |
| | | | | 424/93.71 |
| 2017/0296623 | A1 * | 10/2017 | Juillerat | A61K 38/17 |
| 2018/0079812 | A1 * | 3/2018 | Lim | C07K 16/28 |
| 2018/0208636 | A1 * | 7/2018 | Lim | C07K 16/28 |
| 2018/0355011 | A1 * | 12/2018 | Lim | C07K 16/28 |
| 2019/0248869 | A1 * | 8/2019 | Gross | A61K 35/17 |

FOREIGN PATENT DOCUMENTS

| | | |
|---|---|---|
| WO | 2014145252 A2 | 9/2014 |
| WO | 2014165707 A2 | 10/2014 |
| WO | WO-2015/142314 A1 | 9/2015 |
| WO | 2016014565 A2 | 1/2016 |
| WO | WO-2016/097231 A2 | 6/2016 |
| WO | WO-2016/097231 A3 | 6/2016 |

OTHER PUBLICATIONS

Fedorov et al Science Translation Medicine, 5, 215, 615ra172 (Year: 2013).*
Hoogi et al. Journal for ImmunoTherapy of Cancer 7:243-255 (2019).*
Juillerat et al. BMC Biotechnology 19:44-52 (2019).*
Santoro et al. Cancer Immunol Res. 3(1): 68-84 (Jan. 2015).*
Sommer et al. Molecular Therapy 27(6): 1126-1138 (Jun. 2019).*
Valton et al. Molecular Therapy 23(9): 1507-1518 (Sep. 2015).*
European Communication Pursuant to Article 94(3) EPC dated Jun. 21, 2018, for EP Application No. 15 798 238.0, filed on Nov. 9, 2015, 4 pages.
Fedorov, V., et al., "PD-1- and CTLA-4-Based Inhibitory Chimeric Antigen Receptors (iCARs) Divert Off-Target Immunotherapy Responses," Science Translational Medicine, 2013, 1-12, vol. 5, No. 215.

(Continued)

*Primary Examiner* — Lynn A Bristol
(74) *Attorney, Agent, or Firm* — Proskauer Rose LLP

(57) ABSTRACT

The invention relates to an inhibitory chimeric antigen receptor (N-CAR) comprising an extracellular domain comprising an antigen binding domain, a transmembrane domain, and, an intracellular domain wherein the intracellular domain comprises an Immunoreceptor Tyrosine-based Switch Motif ITSM, wherein said ITSM is a sequence of amino acid $TX_1YX_2X_3X_4$, wherein $X_1$ is an amino acid $X_2$ is an amino acid $X_3$ is an amino acid and $X_4$ is V or I.

21 Claims, 13 Drawing Sheets
Specification includes a Sequence Listing.

(56) References Cited

OTHER PUBLICATIONS

International Preliminary Report on Patentability for International Appln No. PCT/IB2015/058650 dated May 16, 2017.
International Search Report for International Appln No. PCT/IB2015/058650 completed on Mar. 23, 2016.
Morgan, R., et al., "Boolean Immunotherapy: Reversal of Fortune," Molecular Therapy, 2014, 1073,1074, vol. 22, No. 6.
Riley, J., et al., "PD-1 signaling in primary T cells," Immunological Reviews, 2009, 114-125, vol. 229, No. 1.
Shinohara, T., et al., "Programmed cell death protein 1," Database UniProt [Online], 1994, Database accession No. q15116.
Staub, E., et al., "Systematic identification of immunoreceptor tyrosine-based inhibitory motifs in the human proteome," Cellular Signalling, 2004, 435-456, vol. 16.
Chemnitz, J.M. et al. (2004). "SHP-1 and SHP-2 associate with immunoreceptor tyrosine-based switch motif of programmed death 1 upon primary human T cell stimulation, but only receptor ligation prevents T cell activation," J. Immunol. 173:945-954.
Parry, R.V. et al. (2005). "CTLA-4 and PD-1 receptors inhibit T-cell activation by distinct mechanisms," Mol. Cell. Biol. 25:9543-9553.
Stephan, M.T. et al. (2007). "T cell-encoded CD80 and 4-1BBL induce auto- and transcostimulation, resulting in potent tumor rejection," Nat. Med. 13:1440-1449.
Yokosuka, T. et al. (2012). "Programmed cell death 1 forms negative costimulatory microclusters that directly inhibit T cell receptor signaling by recruiting phosphates SHP2," J. Exp. Med. 209:1201-1217.
Riddell, S. et al (2013). Chimeric Antigen Receptor-Modified T Cells: Clinical Translation in Stem Cell Transplantation and Beyond, Biol Blood Marrow Transplant 19 (2013): S2-S5.

* cited by examiner

INHIBITORY CHIMERIC ANTIGEN RECEPTORS

CROSS-REFERENCE TO RELATED APPLICATIONS

This application is a § 371 filing of PCT/162015/058650 filed Nov. 9, 2015, which claims the benefit of U.S. Provisional Application No. 62/078,927 filed Nov. 12, 2014, and U.S. Provisional Application No. 62/081,960 filed Nov. 19, 2014, both of which are hereby incorporated by reference in their entireties.

SEQUENCE LISTING

The instant application contains a Sequence Listing which has been submitted electronically in ASCII format and is hereby incorporated by reference in its entirety. Said ASCII copy, created on Nov. 7, 2019, is named ALGN-002_02US_333466-2020_SL.txt and is 998,701 bytes in size.

FIELD OF THE INVENTION

The invention relates to negative T-cell signal inducing chimeric antigen receptor (N-CAR or ICAR) and to T-cells comprising such N-CAR as well as a positive T-cell signal inducing CAR (P-CAR) as well as their use in therapy.

BACKGROUND

T-cell therapies based on redirected T-cell targeting using chimeric antigen receptor (CAR) are beginning to show great promise in the clinic, particularly in the oncology setting (see Hutchinson L., *Nat Rev Clin Oncol.* 2014 Oct. 28; Lee D W et al., *Lancet.* 2014 Oct. 10. pii: S0140-6736 (14)61403-3 or Grupp S A et al., *N Engl J Med.* 2013 Apr. 18; 368(16):1509-18). Given the growing enthusiasm of the field, there is a significant effort being made to identify appropriate targets for CAR T-cell therapy. Given the potency of such therapeutics, the field's ability to identify novel targets for such therapy is hindered by concerns about on-target off-tissue (meaning off-tumor) activity. Such events not only mitigate efficacy but also present tremendous safety challenges as demonstrated by recent clinical events (see Morgan R A et al., *Mol Ther.* 2010 April; 18(4):843-51; Morgan R A et al., *J Immunother.* 2013 February; 36(2):133-51 or Linette G P et al., *Blood* 2013 Aug. 8; 122(6):863-71). Clinical approaches to mitigate these safety concerns while effective also act directly or indirectly on the infused CAR T-cell therapeutic entities.

In order to address these safety issues pertaining to on-target off-tissue activity of CAR T-cells, and expand the target space amenable to this mode of therapeutics, there is growing emphasis in creating logic gates to modulate T-cell signaling (see Federov V D et al., *Sci Transl Med.* 2013 Dec. 11; 5(215):215ra172).

One such approach involves using a NOT gate, wherein the T-cell expresses two or more CARs on its cell surface. CARs that provide positive T-cell signals (P-CARs) bind to tumor antigens to enable T-cell activation and/or proliferation and/or cytokine secretion, and/or cytotoxicity mediated by CD3zeta or other immunoreceptor tyrosine-based activation motif (ITAM) containing motifs; while CARs that provide a negative T-cell signal (N-CARs) bind to the off-tissue antigens and attenuate or abrogate the positive signals.

Therefore under the on-tissue (on-tumor) scenario the T-cell only receives the P-CAR signal and subsequent activation and cytotoxicity and in the off-tissue (off-tumor) scenario the T-cell receives both the P-CAR and N-CAR signals, whereby the latter attenuates or terminates downstream signaling leading to impaired or no activation and cytotoxicity.

Therefore, there is a need for negative or inhibitory CAR (N-CAR) that can be used to generate a negative signal suitable to prevent off target activation of P-CAR T-cells (T-cells comprising a P-CAR). It would be an additional benefit if such negative signal is short-termed, reversible and sufficient to attenuate or prevent on-target off-tissue activity of CAR T-cells comprising such N-CAR.

DETAILED DESCRIPTION OF THE INVENTION

General Techniques

The practice of the present invention will employ, unless otherwise indicated, conventional techniques of molecular biology (including recombinant techniques), microbiology, cell biology, biochemistry and immunology, which are within the skill of the art. Such techniques are explained fully in the literature, such as, *Molecular Cloning: A Laboratory Manual*, second edition (Sambrook et al., 1989) Cold Spring Harbor Press; Oligonucleotide Synthesis (M. J. Gait, ed., 1984); Methods in Molecular Biology, Humana Press; Cell Biology: A Laboratory Notebook (J. E. Cellis, ed., 1998) Academic Press; Animal Cell Culture (R. I. Freshney, ed., 1987); Introduction to Cell and Tissue Culture (J. P. Mather and P. E. Roberts, 1998) Plenum Press; Cell and Tissue Culture: Laboratory Procedures (A. Doyle, J. B. Griffiths, and D. G. Newell, eds., 1993-1998) J. Wiley and Sons; Methods in Enzymology (Academic Press, Inc.); Handbook of Experimental Immunology (D. M. Weir and C. C. Blackwell, eds.); Gene Transfer Vectors for Mammalian Cells (J. M. Miller and M. P. Calos, eds., 1987); Current Protocols in Molecular Biology (F. M. Ausubel et al., eds., 1987); PCR: The Polymerase Chain Reaction, (Mullis et al., eds., 1994); Current Protocols in Immunology (J. E. Coligan et al., eds., 1991); Short Protocols in Molecular Biology (Wiley and Sons, 1999); Immunobiology (C. A. Janeway and P. Travers, 1997); Antibodies (P. Finch, 1997); Antibodies: a practical approach (D. Catty., ed., IRL Press, 1988-1989); Monoclonal antibodies: a practical approach (P. Shepherd and C. Dean, eds., Oxford University Press, 2000); Using antibodies: a laboratory manual (E. Harlow and D. Lane (Cold Spring Harbor Laboratory Press, 1999); The Antibodies (M. Zanetti and J. D. Capra, eds., Harwood Academic Publishers, 1995).

Definitions

The following terms, unless otherwise indicated, shall be understood to have the following meanings: the term "isolated molecule" as referring to a molecule (where the molecule is, for example, a polypeptide, a polynucleotide, or an antibody) that by virtue of its origin or source of derivation (1) is not associated with naturally associated components that accompany it in its native state, (2) is substantially free of other molecules from the same source, e.g., species, cell from which it is expressed, library, etc., (3) is expressed by a cell from a different species, or (4) does not occur in nature. Thus, a molecule that is chemically synthesized, or expressed in a cellular system different from the system from which it naturally originates, will be "isolated"

from its naturally associated components. A molecule also may be rendered substantially free of naturally associated components by isolation, using purification techniques well known in the art. Molecule purity or homogeneity may be assayed by a number of means well known in the art. For example, the purity of a polypeptide sample may be assayed using polyacrylamide gel electrophoresis and staining of the gel to visualize the polypeptide using techniques well known in the art. For certain purposes, higher resolution may be provided by using HPLC or other means well known in the art for purification.

An "antibody" is an immunoglobulin molecule capable of specific binding to a target, such as a carbohydrate, polynucleotide, lipid, polypeptide, etc., through at least one antigen recognition site, located in the variable region of the immunoglobulin molecule. As used herein, the term encompasses not only intact polyclonal or monoclonal antibodies, but also, unless otherwise specified, any antigen binding portion thereof that competes with the antibody for specific binding, fusion proteins comprising an antigen binding portion, and any other modified configuration of the immunoglobulin molecule that comprises an antigen recognition site. Antigen binding portions include, for example, Fab, Fab', F(ab')2, Fd, Fv, domain antibodies (dAbs, e.g., shark and camelid antibodies), fragments including complementarity determining regions (CDRs), single chain variable fragment antibodies (scFv), maxibodies, minibodies, intrabodies, diabodies, triabodies, tetrabodies, v-NAR and bis-scFv, and polypeptides that contain at least a portion of an immunoglobulin that is sufficient to confer specific antigen binding to the polypeptide. An antibody includes an antibody of any class, such as IgG, IgA, or IgM (or sub-class thereof), and the antibody need not be of any particular class. Depending on the antibody amino acid sequence of the constant region of its heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA1 and IgA2. The heavy-chain constant regions that correspond to the different classes of immunoglobulins are called alpha, delta, epsilon, gamma, and mu, respectively. The subunit structures and three-dimensional configurations of different classes of immunoglobulins are well known.

A "variable region" of an antibody refers to the variable region of the antibody light chain or the variable region of the antibody heavy chain, either alone or in combination. As known in the art, the variable regions of the heavy and light chains each consist of four framework regions (FRs) connected by three complementarity determining regions (CDRs) also known as hypervariable regions, and contribute to the formation of the antigen binding site of antibodies. If variants of a subject variable region are desired, particularly with substitution in amino acid residues outside of a CDR region (e.g., in the framework region), appropriate amino acid substitution, preferably, conservative amino acid substitution, can be identified by comparing the subject variable region to the variable regions of other antibodies which contain CDR1 and CDR2 sequences in the same canonincal class as the subject variable region (Chothia and Lesk, J Mol Biol 196(4): 901-917, 1987).

In certain embodiments, definitive delineation of a CDR and identification of residues comprising the binding site of an antibody is accomplished by solving the structure of the antibody and/or solving the structure of the antibody-ligand complex. In certain embodiments, that can be accomplished by any of a variety of techniques known to those skilled in the art, such as X-ray crystallography. In certain embodiments, various methods of analysis can be employed to identify or approximate the CDR regions. In certain embodiments, various methods of analysis can be employed to identify or approximate the CDR regions. Examples of such methods include, but are not limited to, the Kabat definition, the Chothia definition, the AbM definition, the contact definition, and the conformational definition.

The Kabat definition is a standard for numbering the residues in an antibody and is typically used to identify CDR regions. See, e.g., Johnson & Wu, 2000, Nucleic Acids Res., 28: 214-8. The Chothia definition is similar to the Kabat definition, but the Chothia definition takes into account positions of certain structural loop regions. See, e.g., Chothia et al., 1986, J. Mol. Biol., 196: 901-17; Chothia et al., 1989, Nature, 342: 877-83. The AbM definition uses an integrated suite of computer programs produced by Oxford Molecular Group that model antibody structure. See, e.g., Martin et al., 1989, Proc Natl Acad Sci (USA), 86:9268-9272; "AbM™, A Computer Program for Modeling Variable Regions of Antibodies," Oxford, UK; Oxford Molecular, Ltd. The AbM definition models the tertiary structure of an antibody from positive sequence using a combination of knowledge databases and ab initio methods, such as those described by Samudrala et al., 1999, "Ab Initio Protein Structure Prediction Using a Combined Hierarchical Approach," in PROTEINS, Structure, Function and Genetics Suppl., 3:194-198. The contact definition is based on an analysis of the available complex crystal structures. See, e.g., MacCallum et al., 1996, J. Mol. Biol., 5:732-45. In another approach, referred to herein as the "conformational definition" of CDRs, the positions of the CDRs may be identified as the residues that make enthalpic contributions to antigen binding. See, e.g., Makabe et al., 2008, Journal of Biological Chemistry, 283:1156-1166. Still other CDR boundary definitions may not strictly follow one of the above approaches, but will nonetheless overlap with at least a portion of the Kabat CDRs, although they may be shortened or lengthened in light of prediction or experimental findings that particular residues or groups of residues do not significantly impact antigen binding. As used herein, a CDR may refer to CDRs defined by any approach known in the art, including combinations of approaches. The methods used herein may utilize CDRs defined according to any of these approaches. For any given embodiment containing more than one CDR, the CDRs may be defined in accordance with any of Kabat, Chothia, extended, AbM, contact, and/or conformational definitions.

As known in the art, a "constant region" of an antibody refers to the constant region of the antibody light chain or the constant region of the antibody heavy chain, either alone or in combination.

As used herein, "monoclonal antibody" refers to an antibody obtained from a population of substantially homogeneous antibodies, i.e., the individual antibodies comprising the population are identical except for possible naturally-occurring mutations that may be present in minor amounts. Monoclonal antibodies are highly specific, being directed against a single antigenic site. Furthermore, in contrast to polyclonal antibody preparations, which typically include different antibodies directed against different determinants (epitopes), each monoclonal antibody is directed against a single determinant on the antigen. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler and Milstein, 1975, Nature 256:495, or may be made by recombinant DNA methods such as described in U.S. Pat. No. 4,816,567. The monoclonal antibodies may also be isolated from phage libraries generated using the techniques described in McCafferty et al., 1990, Nature 348:552-554, for example. As used herein, "humanized" antibody refers to forms of non-human (e.g. murine) antibodies that are chimeric immunoglobulins, immunoglobulin chains, or fragments thereof (such as Fv, Fab, Fab', F(ab')2 or other antigen-binding subsequences of antibodies) that contain minimal sequence derived from non-human immunoglobulin. Preferably, humanized antibodies are human immunoglobulins (recipient antibody) in which residues from a CDR of the recipient are replaced by residues from a CDR of a non-human species (donor antibody) such as mouse, rat, or rabbit having the desired specificity, affinity, and capacity. The humanized antibody may comprise residues that are found neither in the recipient antibody nor in the imported CDR or framework sequences, but are included to further refine and optimize antibody performance.

A "human antibody" is one which possesses an amino acid sequence which corresponds to that of an antibody produced by a human and/or has been made using any of the techniques for making human antibodies as disclosed herein. This definition of a human antibody specifically excludes a humanized antibody comprising non-human antigen binding residues.

The term "chimeric antibody" is intended to refer to antibodies in which the variable region sequences are derived from one species and the constant region sequences are derived from another species, such as an antibody in which the variable region sequences are derived from a mouse antibody and the constant region sequences are derived from a human antibody.

The term "epitope" refers to that portion of a molecule capable of being recognized by and bound by an antibody at one or more of the antibody's antigen-binding regions. Epitopes often consist of a surface grouping of molecules such as amino acids or sugar side chains and have specific three-dimensional structural characteristics as well as specific charge characteristics. In some embodiments, the epitope can be a protein epitope. Protein epitopes can be linear or conformational. In a linear epitope, all of the points of interaction between the protein and the interacting molecule (such as an antibody) occur linearly along the positive amino acid sequence of the protein. A "nonlinear epitope" or "conformational epitope" comprises noncontiguous polypeptides (or amino acids) within the antigenic protein to which an antibody specific to the epitope binds. The term "antigenic epitope" as used herein, is defined as a portion of an antigen to which an antibody can specifically bind as determined by any method well known in the art, for example, by conventional immunoassays. Once a desired epitope on an antigen is determined, it is possible to generate antibodies to that epitope, e.g., using the techniques described in the present specification. Alternatively, during the discovery process, the generation and characterization of antibodies may elucidate information about desirable epitopes. From this information, it is then possible to competitively screen antibodies for binding to the same epitope. An approach to achieve this is to conduct competition and cross-competition studies to find antibodies that compete or cross-compete with one another for binding to the antigen.

The term "signaling domain" refers to the functional portion of a protein which acts by transmitting information within the cell to regulate cellular activity via defined signaling pathways by generating second messengers or functioning as effectors by responding to such messengers.

The term "off-tissue antigen" (or off-tumor antigen) refers to an antigen which is present on non-tumor tissue and not present on the tumor of interest (tumor to be treated by the cells of the invention comprising a P-CAR directed to a tumor antigen and a N-CAR directed to an off-tissue antigen), or only present on the tumor of interest at much lower levels compared to levels of tumor antigen (i.e. the antigen present on the tumor of interest and targeted by the P-CAR).

The term "anti-tumor effect" refers to a biological effect which can be manifested by various means, including but not limited to, e.g., a decrease in tumor volume, a decrease in the number of tumor cells, a decrease in the number of metastases, an increase in life expectancy, decrease in tumor cell proliferation, decrease in tumor cell survival, or amelioration of various physiological symptoms associated with the cancerous condition. An "anti-tumor effect" can also be manifested by the ability of the cells of the invention in prevention of the occurrence of tumor in the first place.

The term "autologous" refers to any material derived from the same individual to whom it is later to be re-introduced into the individual.

The term "allogeneic" refers to any material derived from a different animal of the same species as the individual to whom the material is introduced. Two or more individuals are said to be allogeneic to one another when the genes at one or more loci are not identical. In some aspects, allogeneic material from individuals of the same species may be sufficiently unlike genetically to interact antigenically The term "xenogeneic" refers to a graft derived from an animal of a different species.

The term "cancer" refers to a disease characterized by the rapid and uncontrolled growth of aberrant cells. Cancer cells can spread locally or through the bloodstream and lymphatic system to other parts of the body. Examples of various cancers are described herein and include but are not limited to, breast cancer, prostate cancer, ovarian cancer, cervical cancer, skin cancer, pancreatic cancer, colorectal cancer, renal cell cancer, liver cancer, brain cancer, lymphoma, leukemia, lung cancer and the like.

The term "conservative sequence modifications" refers to amino acid modifications that do not significantly affect or alter the binding characteristics of the antibody or antibody fragment containing the amino acid sequence. Such conservative modifications include amino acid substitutions, additions and deletions. Modifications can be introduced into an antibody or antibody fragment of the invention by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a CAR of the invention can be replaced with other amino acid residues from the same side chain family and the altered CAR can be tested using the functional assays described herein.

In some embodiments, the "fragment" of a sequence of amino acids is shorter than said sequence of amino acid. In some embodiments, the fragment of a sequence of amino acids is at least 1%, 5% 10%, 20%, 40%, 50%, 60%, 70%, 80% or 90% shorter than said sequence of amino acids. In some embodiments, the fragment of a sequence of amino acids is shorter by at least 1, 5, 10, 20, 50, 100, 200, 300 amino acids as compared to said sequence of amino acids.

Unless otherwise specified, the left to right orientation of amino acid sequences or formula representing amino acid sequences are disclosed using the conventional left to right orientation N-Term to C-term.

N-terminal flanking region of a domain refers to the sequence of amino acid which is directly adjacent to the N-terminal amino acid of said domain. C-terminal flanking region of a domain refers to the sequence of amino acid which is directly adjacent to the C-terminal amino acid of said domain. For example, in the sequence seq1-ITIM-seq2, seq1 is the N-terminal flanking region of the ITIM intracellular domain and seq2 N-terminal flanking region of the ITIM intracellular domain. In another example, the naturally occurring N-terminal flanking region of ITIM.*ITSM intracellular domains is the sequence of amino acid which is directly adjacent to the N-terminal amino acid of the ITIM motif of the ITIM.*ITSM intracellular domain. In another example, the naturally occurring C-terminal flanking region of ITIM.*ITSM intracellular domain is the sequence of amino acid which is directly adjacent to the C-terminal amino acid of the ITSM motif of the ITIM.*ITSM intracellular domain.

In another example, the naturally occurring N-terminal flanking region of an ITIM only intracellular domain is the sequence of amino acid which is directly adjacent to the N-terminal amino acid of the ITIM of the ITIM only intracellular domain. In another example, the naturally occurring C-terminal flanking region of an ITIM only intracellular domain is the sequence of amino acid which is directly adjacent to the C-terminal amino acid of the ITIM of the ITIM only intracellular domain.

In another example, the naturally occurring N-terminal flanking region of an ITSM only intracellular domain is the sequence of amino acid which is directly adjacent to the N-terminal amino acid of the ITSM of the ITSM only intracellular domain. In another example, the naturally occurring C-terminal flanking region of an ITSM only intracellular domain is the sequence of amino acid which is directly adjacent to the C-terminal amino acid of the ITSM of the ITSM only intracellular domain.

The term "stimulation," refers to a positive response induced by binding of a stimulatory molecule (e.g., a TCR/CD3 complex) with its cognate ligand thereby mediating a signal transduction event, such as, but not limited to, signal transduction via the TCR/CD3 complex. Stimulation can mediate altered expression of certain molecules, such as downregulation of TGF-β, and/or reorganization of cytoskeletal structures, and the like.

The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

An "intracellular signaling domain," as the term is used herein, refers to an intracellular portion of a molecule.

The term "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or a RNA may also include introns to the extent that the nucleotide sequence encoding the protein may in some version contain an intron(s).

The term "effective amount" or "therapeutically effective amount" are used interchangeably herein, and refer to an amount of a compound, formulation, material, or composition, as described herein effective to achieve a particular biological result.

The term "endogenous" refers to any material from or produced inside an organism, cell, tissue or system.

The term "exogenous" refers to any material introduced from or produced outside an organism, cell, tissue or system.

The term "expression" refers to the transcription and/or translation of a particular nucleotide sequence driven by a promoter.

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a polylysine compound, liposome, and the like. Examples of viral transfer vectors include, but are not limited to, adenoviral vectors, adeno-associated virus vectors, retroviral vectors, lentiviral vectors, and the like.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses.

The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art.

The term "homologous" or "identity" refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous or identical at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Operably linked DNA sequences can be contiguous with each other and, e.g., where necessary to join two protein coding regions, are in the same reading frame.

The terms "polypeptide", "oligopeptide", "peptide" and "protein" are used interchangeably herein to refer to chains of amino acids of any length. The chain may be linear or branched, it may comprise modified amino acids, and/or may be interrupted by non-amino acids. The terms also encompass an amino acid chain that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids, etc.), as well as other modifications known in the art. It is understood that the polypeptides can occur as single chains or associated chains.

As known in the art, "polynucleotide," or "nucleic acid," as used interchangeably herein, refer to chains of nucleotides of any length, and include DNA and RNA. The nucleotides can be deoxyribonucleotides, ribonucleotides, modified nucleotides or bases, and/or their analogs, or any substrate that can be incorporated into a chain by DNA or RNA polymerase. A polynucleotide may comprise modified nucleotides, such as methylated nucleotides and their analogs. If present, modification to the nucleotide structure may be imparted before or after assembly of the chain. The sequence of nucleotides may be interrupted by non-nucleotide components. A polynucleotide may be further modified after polymerization, such as by conjugation with a labeling component. Other types of modifications include, for example, "caps", substitution of one or more of the naturally occurring nucleotides with an analog, internucleotide modifications such as, for example, those with uncharged linkages (e.g., methyl phosphonates, phosphotriesters, phosphoamidates, carbamates, etc.) and with charged linkages (e.g., phosphorothioates, phosphorodithioates, etc.), those containing pendant moieties, such as, for example, proteins (e.g., nucleases, toxins, antibodies, signal peptides, poly-L-lysine, etc.), those with intercalators (e.g., acridine, psoralen, etc.), those containing chelators (e.g., metals, radioactive metals, boron, oxidative metals, etc.), those containing alkylators, those with modified linkages (e.g., alpha anomeric nucleic acids, etc.), as well as unmodified forms of the polynucleotide(s). Further, any of the hydroxyl groups ordinarily present in the sugars may be replaced, for example, by phosphonate groups, phosphate groups, protected by standard protecting groups, or activated to prepare additional linkages to additional nucleotides, or may be conjugated to solid supports. The 5' and 3' terminal OH can be phosphorylated or substituted with amines or organic capping group moieties of from 1 to 20 carbon atoms. Other hydroxyls may also be derivatized to standard protecting groups. Polynucleotides can also contain analogous forms of ribose or deoxyribose sugars that are generally known in the art, including, for example, 2'-O-methyl-, 2'-O-allyl, 2'-fluoro- or 2'-azido-ribose, carbocyclic sugar analogs, alpha- or beta-anomeric sugars, epimeric sugars such as arabinose, xyloses or lyxoses, pyranose sugars, furanose sugars, sedoheptuloses, acyclic analogs and abasic nucleoside analogs such as methyl riboside. One or more phosphodiester linkages may be replaced by alternative linking groups. These alternative linking groups include, but are not limited to, embodiments wherein phosphate is replaced by P(O)S("thioate"), P(S)S ("dithioate"), (O)NR$_2$ ("amidate"), P(O)R, P(O)OR', CO or CH$_2$ ("formacetal"), in which each R or R' is independently H or substituted or unsubstituted alkyl (1-20 C) optionally containing an ether (—O—) linkage, aryl, alkenyl, cycloalkyl, cycloalkenyl or araldyl. Not all linkages in a polynucleotide need be identical. The preceding description applies to all polynucleotides referred to herein, including RNA and DNA.

An antibody that "preferentially binds" or "specifically binds" (used interchangeably herein) to an epitope is a term well understood in the art, and methods to determine such specific or preferential binding are also well known in the art. A molecule is said to exhibit "specific binding" or "preferential binding" if it reacts or associates more frequently, more rapidly, with greater duration and/or with greater affinity with a particular cell or substance than it does with alternative cells or substances. An antibody "specifically binds" or "preferentially binds" to a target if it binds with greater affinity, avidity, more readily, and/or with greater duration than it binds to other substances.

A "host cell" includes an individual cell or cell culture that can be or has been a recipient for vector(s) for incorporation of polynucleotide inserts. Host cells include progeny of a single host cell, and the progeny may not necessarily be completely identical (in morphology or in genomic DNA complement) to the original parent cell due to natural, accidental, or deliberate mutation. A host cell includes cells transfected in vivo with a polynucleotide(s) of this invention.

The term "compete", as used herein with regard to an antibody, means that a first antibody, or an antigen-binding portion thereof, binds to an epitope in a manner sufficiently similar to the binding of a second antibody, or an antigenbinding portion thereof, such that the result of binding of the first antibody with its cognate epitope is detectably decreased in the presence of the second antibody compared to the binding of the first antibody in the absence of the second antibody. The alternative, where the binding of the second antibody to its epitope is also detectably decreased in the presence of the first antibody, can, but need not be the case. That is, a first antibody can inhibit the binding of a second antibody to its epitope without that second antibody inhibiting the binding of the first antibody to its respective epitope. However, where each antibody detectably inhibits the binding of the other antibody with its cognate epitope or ligand, whether to the same, greater, or lesser extent, the antibodies are said to "cross-compete" with each other for binding of their respective epitope(s). Both competing and cross-competing antibodies are encompassed by the present invention. Regardless of the mechanism by which such competition or cross-competition occurs (e.g., steric hindrance, conformational change, or binding to a common epitope, or portion thereof), the skilled artisan would appreciate, based upon the teachings provided herein, that such competing and/or cross-competing antibodies are encompassed and can be useful for the methods disclosed herein.

As used herein, "treatment" is an approach for obtaining beneficial or desired clinical results.

As used herein, an "effective dosage" or "effective amount" of drug, compound, or pharmaceutical composition is an amount sufficient to effect any one or more beneficial or desired results. For prophylactic use, beneficial or desired results include eliminating or reducing the risk, lessening the severity, or delaying the outset of the disease, including biochemical, histological and/or behavioral symptoms of the disease, its complications and intermediate pathological phenotypes presenting during development of the disease. For therapeutic use, beneficial or desired results include clinical results such as reducing incidence or amelioration of one or more symptoms of various diseases or conditions (such as, for example without limitation, renal cell, gastric, head and neck, lung, ovarian, and pancreatic cancers), decreasing the dose of other medications required to treat the disease, enhancing the effect of another medication, and/or delaying the progression of the disease. An effective dosage can be administered in one or more administrations. For purposes of this invention, an effective dosage of drug, compound, or pharmaceutical composition is an amount sufficient to accomplish prophylactic or therapeutic treatment either directly or indirectly. As is understood in the clinical context, an effective dosage of a drug, compound, or pharmaceutical composition may or may not be achieved in conjunction with another drug, compound, or pharmaceutical composition. Thus, an "effective dosage" may be considered in the context of administering one or more therapeutic agents, and a single agent may be considered to be given in an effective amount if, in conjunction with one or more other agents, a desirable result may be or is achieved.

An "individual" or a "subject" is a mammal, more preferably, a human. Mammals also include, but are not limited to, farm animals, sport animals, pets, primates, horses, dogs, cats, mice and rats.

As used herein, "vector" means a construct, which is capable of delivering, and, preferably, expressing, one or more gene(s) or sequence(s) of interest in a host cell. Examples of vectors include, but are not limited to, viral vectors, naked DNA or RNA expression vectors, plasmid, cosmid or phage vectors, DNA or RNA expression vectors associated with cationic condensing agents, DNA or RNA expression vectors encapsulated in liposomes, and certain eukaryotic cells, such as producer cells.

As used herein, "expression control sequence" means a nucleic acid sequence that directs transcription of a nucleic acid. An expression control sequence can be a promoter, such as a constitutive or an inducible promoter, or an enhancer. The expression control sequence is operably linked to the nucleic acid sequence to be transcribed.

The term "promoter" refers to a DNA sequence recognized by the synthetic machinery of the cell, or introduced synthetic machinery, required to initiate the specific transcription of a polynucleotide sequence.

The term "promoter/regulatory sequence" refers to a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a tissue specific manner.

The term "constitutive" promoter refers to a nucleotide sequence which, when operably linked with a polynucleotide which encodes or specifies a gene product, causes the gene product to be produced in a cell under most or all physiological conditions of the cell.

The term "inducible" promoter refers to a nucleotide sequence which, when operably linked with a polynucleotide which encodes or specifies a gene product, causes the gene product to be produced in a cell substantially only when an inducer which corresponds to the promoter is present in the cell.

The term "tissue-specific" promoter refers to a nucleotide sequence which, when operably linked with a polynucleotide encodes or specified by a gene, causes the gene product to be produced in a cell substantially only if the cell is a cell of the tissue type corresponding to the promoter.

The term "flexible polypeptide linker" or "linker" as used in the context of a scFv refers to a peptide linker that consists of amino acids such as glycine and/or serine residues used alone or in combination, to link variable heavy and variable light chain regions together. In one embodiment, the flexible polypeptide linker is a Glycine/Serine linker and comprises the amino acid sequence (Gly-Gly-Gly-Ser)$_n$ (SEQ ID NO: 2030) or (Gly-Gly-Gly-Gly-Ser)$_n$ (SEQ ID NO: 2031), where n is a positive integer equal to or greater than 1. For example, n=1, n=2, n=3, n=4, n=5, n=6, n=7, n=8, n=9 and n=10. In one embodiment, the flexible polypeptide linkers include, but are not limited to, (Gly$_4$Ser)$_4$ (SEQ ID NO: 2032) or (Gly$_4$Ser)$_3$ (SEQ ID NO: 2033). In another embodiment, the linkers include multiple repeats of (Gly$_x$Ser)$_n$, where x=1, 2, 3, 4 or 5 and n is 1, 2, 3, 4, 5, 6, 7, 8, 9 or 10 (SEQ ID NO: 2034), such as multiple repeat of (GlySer), (Gly$_2$Ser) or (Gly$_5$Ser) (SEQ ID NO: 2035). Also included within the scope of the invention are linkers described in WO2012/138475, incorporated herein by reference.

As used herein, a 5' cap (also termed an RNA cap, an RNA 7-methylguanosine cap or an RNA m G cap) is a modified guanine nucleotide that has been added to the "front" or 5' end of a eukaryotic messenger RNA shortly after the start of transcription. The 5' cap consists of a terminal group which is linked to the first transcribed nucleotide. Its presence is critical for recognition by the ribosome and protection from RNases. Cap addition is coupled to transcription, and occurs co-transcriptionally, such that each influences the other. Shortly after the start of transcription, the 5' end of the mRNA being synthesized is bound by a cap-synthesizing complex associated with RNA polymerase. This enzymatic complex catalyzes the chemical reactions that are required for mRNA capping. Synthesis proceeds as a multi-step biochemical reaction. The capping moiety can be modified to modulate functionality of mRNA such as its stability or efficiency of translation.

As used herein, "in vitro transcribed RNA" refers to RNA, preferably mRNA, that has been synthesized in vitro. Generally, the in vitro transcribed RNA is generated from an in vitro transcription vector. The in vitro transcription vector comprises a template that is used to generate the in vitro transcribed RNA.

As used herein, a "poly(A)" is a series of adenosines attached by polyadenylation to the mRNA. In the preferred embodiment of a construct for transient expression, the polyA is between 50 and 5000 (SEQ ID NO: 2036), preferably greater than 64, more preferably greater than 100, most preferably greater than 300 or 400. poly(A) sequences can be modified chemically or enzymatically to modulate mRNA functionality such as localization, stability or efficiency of translation.

As used herein, "polyadenylation" refers to the covalent linkage of a polyadenylyl moiety, or its modified variant, to a messenger RNA molecule. In eukaryotic organisms, most messenger RNA (mRNA) molecules are polyadenylated at the 3' end. The 3' poly(A) tail is a long sequence of adenine nucleotides (often several hundred) added to the pre-mRNA through the action of an enzyme, polyadenylate polymerase. In higher eukaryotes, the poly(A) tail is added onto transcripts that contain a specific sequence, the polyadenylation signal. The poly(A) tail and the protein bound to it aid in protecting mRNA from degradation by exonucleases. Polyadenylation is also important for transcription termination, export of the mRNA from the nucleus, and translation. Polyadenylation occurs in the nucleus immediately after transcription of DNA into RNA, but additionally can also occur later in the cytoplasm. After transcription has been terminated, the mRNA chain is cleaved through the action of an endonuclease complex associated with RNA polymerase. The cleavage site is usually characterized by the presence of the base sequence AAUAAA near the cleavage site. After the mRNA has been cleaved, adenosine residues are added to the free 3' end at the cleavage site.

As used herein, "transient" refers to expression of a non-integrated transgene for a period of hours, days or weeks, wherein the period of time of expression is less than the period of time for expression of the gene if integrated into the genome or contained within a stable plasmid replicon in the host cell.

The term "signal transduction pathway" refers to the biochemical relationship between a variety of signal transduction molecules that play a role in the transmission of a signal from one portion of a cell to another portion of a cell. The phrase "cell surface receptor" includes molecules and complexes of molecules capable of receiving a signal and transmitting signal across the membrane of a cell.

Reference to "about" a value or parameter herein includes (and describes) embodiments that are directed to that value or parameter per se. For example, description referring to "about X" includes description of "X." Numeric ranges are inclusive of the numbers defining the range. It is understood that wherever embodiments are described herein with the language "comprising," otherwise analogous embodiments described in terms of "consisting of" and/or "consisting essentially of" are also provided.

Where aspects or embodiments of the invention are described in terms of a Markush group or other grouping of alternatives, the present invention encompasses not only the entire group listed as a whole, but each member of the group individually and all possible subgroups of the main group, but also the main group absent one or more of the group members. The present invention also envisages the explicit exclusion of one or more of any of the group members in the claimed invention.

Unless otherwise defined, all technical and scientific terms used herein have the same meaning as commonly understood by one of ordinary skill in the art to which this invention belongs. In case of conflict, the present specification, including definitions, will control. Throughout this specification and claims, the word "comprise," or variations such as "comprises" or "comprising" will be understood to imply the inclusion of a stated integer or group of integers but not the exclusion of any other integer or group of integers. Unless otherwise required by context, singular terms shall include pluralities and plural terms shall include the singular. Any example(s) following the term "e.g." or "for example" is not meant to be exhaustive or limiting.

Exemplary methods and materials are described herein, although methods and materials similar or equivalent to those described herein can also be used in the practice or testing of the present invention. The materials, methods, and examples are illustrative only and not intended to be limiting.

DESCRIPTION OF FIGURES

In FIGS. 1 to 4, P-CAR expression was detected using a recombinant human CD19-mouse IgG Fc fusion protein followed by APC-conjugated F(ab')2 goat anti-mouse Fcγ (shown on x axis), and N-CAR expression was detected with a biotinylated recombinant human PSMA-human IgG1 Fc fusion protein followed by PE-conjugated streptavidin (y axis).

FIGS. 5A/5C and 5B show results using NFAT-luciferase reporter and NFkB-luciferase reporter Jurkat cells, respectively.

In FIGS. 6 to 9, P-CAR expression was detected using a recombinant human CD19-mouse IgG Fc fusion protein followed by APC-conjugated F(ab')2 goat anti-mouse Fcγ (shown on x axis), and N-CAR expression was detected with a biotinylated recombinant human PSMA-human IgG1 Fc fusion protein followed by PE-conjugated streptavidin (y axis).

FIGS. 10A and 10B show results using NFAT-luciferase reporter and NFkB-luciferase reporter Jurkat cells, respectively.

DETAILED DESCRIPTION

Figure 1:
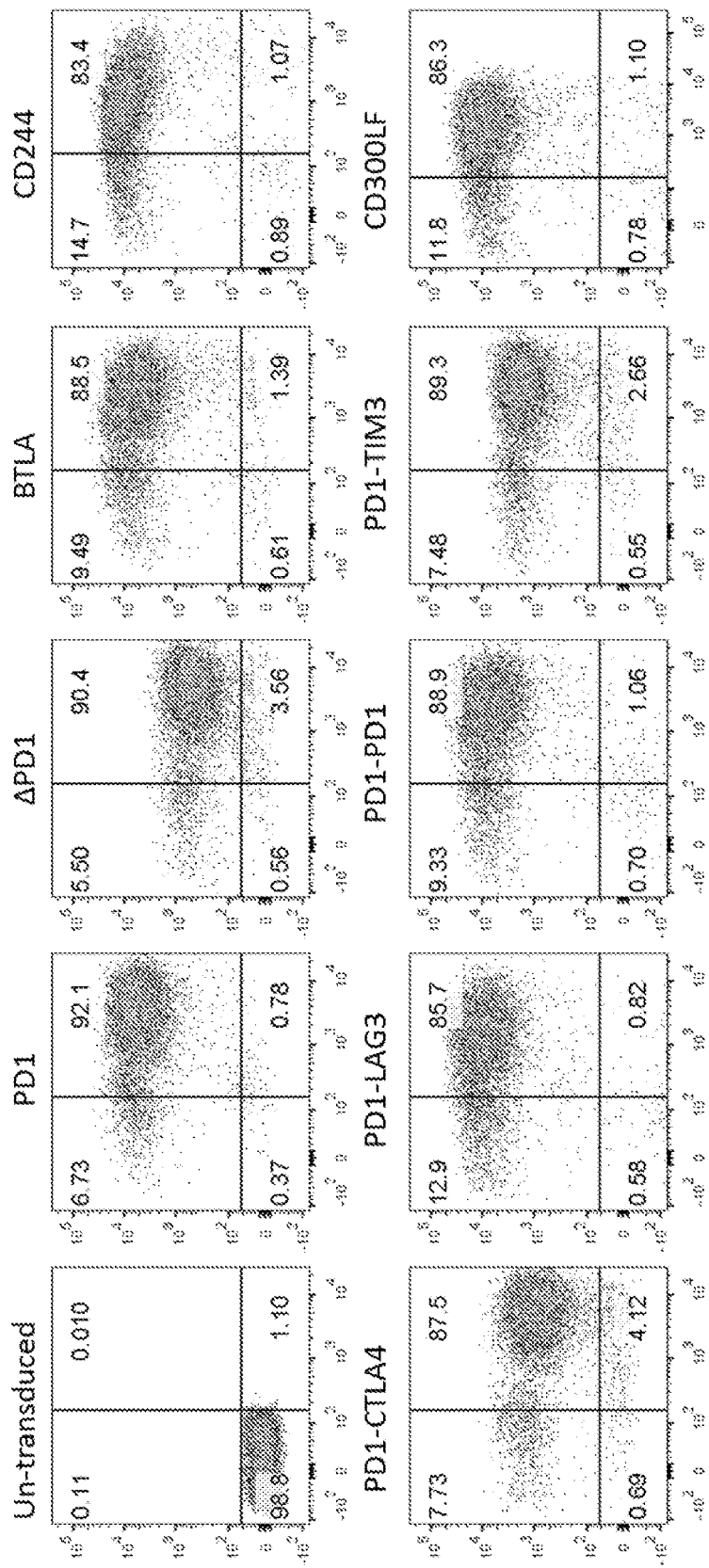
FIGS. 1 and 2 show the dual cell surface expression of P-CAR1 and various N-CARs assessed by multicolor flow cytometry in transduced NFAT-luciferase reporter Jurkat cells.

The invention relates to a negative signal (or inhibitory) chimeric antigen receptor (N-CAR) comprising
an extracellular domain comprising an antigen binding domain,
a transmembrane domain, and,
an intracellular domain
wherein the intracellular domain comprises an immunoreceptor Tyrosine-based Switch Motif ITSM, wherein said ITSM is a sequence of amino acid $TX_1YX_2X_3X_4$ (SEQ ID NO: 2049), wherein
$X_1$ is an amino acid,
$X_2$ is an amino acid,
$X_3$ is an amino acid, and,
$X_4$ is V or I.

In some embodiments the term amino acid refers to a natural amino acid. In some embodiments, the term amino acid refer to an amino acid selected from glycine, alanine, valine, leucine, isoleucine, phenylalanine, proline, serine, threonine, tyrosine, cysteine, methionine, lysine, arginine, histidine, tryptophan, aspartic acid, glutamic acid, asparagine or glutamine.

In some embodiments, when the extracellular domain is a scFv against PSMA, then the intracellular domain is not the intracellular domain of human PD-1.

In some embodiments, the intracellular domain is not the intracellular domain of human PD-1.

In some embodiments, the intracellular domain is not the intracellular domain of human BTLA.

In some embodiments, the intracellular domain is not the intracellular domain of human CD244.

In some embodiments, the intracellular domain is not SEQ ID No 2000, SEQ ID No 2001 or SEQ ID No 2002.

In some embodiments, the extracellular domain does not bind to PMSA.

In some embodiments, the intracellular domain does not comprise the full intracellular domain of PD-1.

In some embodiments, the ITSM is not TEYATI (SEQ ID NO: 937).

The intracellular domain or region of the N-CAR includes an inhibitory intracellular signaling domain. An inhibitory intracellular signaling domain is generally responsible for inactivation of the signal from a positive intracellular signaling domain from a P-CAR on the same immune cell in which the N-CAR has been introduced, thereby blocking activation of a normal effector function of the immune cell. The term "effector function" refers to a specialized function of a cell. Effector function of a T-cell, for example, may be cytolytic activity or helper activity including the secretion of cytokines.

Intracellular Domain of the N-CAR

In some embodiments, the intracellular domain comprises the following sequence:
$((L1\text{-}ITIM\text{-}L2)^n\text{-}(L3\text{-}ITSM\text{-}L4)^m)^p$, wherein
n is 0, 1 or an integer greater than 1;
m is 1 or an integer greater than 1;
p is 1 or an integer greater than 1;
L1 is absent or comprises one or more, preferably one, sequences selected from the group consisting of:
(a) a naturally occurring N-terminal flanking region of an ITIM only intracellular domain or a fragment thereof such as, for example, any of the sequences shown in Table 3 below or a fragment thereof;
(b) a naturally occurring N-terminal flanking region of an ITIM.*ITSM intracellular domain or a fragment thereof, such as, for example, any of the sequences shown in Table 1 below or a fragment thereof;
(c) a naturally occurring intracellular domain from a known inhibitory receptor such as any of the sequences shown in table 2 or a fragment thereof, wherein said intracellular domain is N-terminally flanking to a sequence in (b) above; and
(d) a non-naturally occurring sequence comprising between 1 and 500 amino acids;
each of L2 and L3 is absent or comprises one or more, preferably one, sequences selected from the group consisting of:
(e) a naturally occurring C-terminal flanking region of an ITIM only intracellular domain, such as, for example, any of the sequences shown in Table 4 below or a fragment thereof;
(f) a naturally occurring N-terminal flanking region of an ITSM only intracellular domain such as, for example, any of the sequences shown in Table 6 below or a fragment thereof;
(g) a naturally occurring intracellular domain between ITIM and ITSM from proteins that have ITIM.*ITSM motif such as, for example, any of the sequences shown in Table 5 below or a fragment thereof;
(h) a naturally occurring intracellular domain from a known inhibitory receptor such as any of the sequences shown in table 2 or a fragment thereof, wherein said intracellular domain is N-terminally flanking to a sequence in (f) or (g) above; and
(i) a non-naturally occurring sequence comprising between 1 and 500 amino acids; and
L4 is absent or comprises one or more, preferably one, sequences selected from the group consisting of:
(j) a naturally occurring C-terminal flanking region of an ITIM.*ITSM intracellular domain or a fragment thereof such as, for example, any of the sequences shown in Table 7 below or a fragment thereof;
(k) a naturally occurring C-terminal flanking region of an ITSM only intracellular domain such as, for example, any of the sequences shown in Table 8 below or a fragment thereof;
(l) a naturally occurring intracellular domain from a known inhibitory receptor such as any of the sequences shown in table 2 or a fragment thereof wherein said intracellular domain is C-terminally flanking to a sequence in (j) or (k) above; and
(m) a non-naturally occurring sequence comprising between 1 and 500 amino acids, and, wherein,
the ITIM is the sequence $X_5X_6YX_7X_8X_9$ (SEQ ID NO: 2050), wherein
$X_5$ is S, V, I or L,
$X_6$ is an amino acid, X<sub>7</sub> is an amino acid,
X<sub>8</sub> is an amino acid, and,
X<sub>9</sub> is V, I or L, and,
the ITSM is the sequence TX$_1$YX$_2$X$_3$X$_4$ (SEQ ID NO: 2049), wherein
X$_1$ is an amino acid,
X$_2$ is an amino acid,
X$_3$ is an amino acid, and,
X$_4$ is V or I,
or a variant thereof.

In some embodiments, the known inhibitory receptor refers to an inhibitory receptor comprising an extracellular domain, a transmembrane domain and an intracellular domain which do not comprise any ITIM or ITSM and which provides a negative signal able to reduce the activation signal provided by the TCR/CD3 complex in a T-cell.

In some embodiments, the known inhibitory receptor refers to an inhibitory receptor comprising an extracellular domain, a transmembrane domain and an intracellular domain which provide a negative signal able to reduce the activation signal provided by the TCR/CD3 complex in a T-cell.

In some embodiments, the known inhibitory receptor is selected from CTLA4, LAG3 HAVCR2 (TIM3), KIR2DL2, LILRB1, TIGIT, CEACAM1, CSF1R, CD5, CD96, CD22 and LAIR1. In a preferred embodiment, the known inhibitory receptor is KIR2DL2.

ITIM.*ITSM intracellular domain refers to a domain comprising one ITIM and one ITSM. ITSM only intracellular domain refers to a domain comprising one ITSM and no ITIM. ITIM only intracellular domain refers to a domain comprising one ITIM and no ITSM.

When one or more of n, m or p are greater than 1, each occurrence of L1, L2, L3, L4, ITIM and ITSM is selected independently from the other. For example, the intracellular domain of the N-CAR may comprise several ITSM having different sequences.

In some embodiments, L1 is absent or comprises one or more, preferably one, sequences selected from the group consisting of:
(a) a naturally occurring N-terminal flanking region of ITIM only intracellular domains selected from

YKMYGSEMLHKRDPLDEDEDTD (SEQ ID NO: 4)

DHWALTQRTARAVSPQSTKPMAES (SEQ ID NO: 194)

CSRAARGTIGARRTGQPLKEDPSAVPVFS (SEQ ID NO: 7)

HRQNQIKQGPPRSKDEEQKPQQRPDLAVDVLERTADKATVNGLPEKDRET

DTSALAAGSSQE (SEQ ID NO: 268)

KTHRRKAARTAVGRNDTHPTTGSASPKHQKKSKLHGPTETSSCSGAAPTV

EMDEE (SEQ ID NO: 12)

LTRKKKALRIHSVEGDLRRKSAGQEEWSPSAPSPPGSCVQAEAAPAGLCG

EQRGEDCAELHDYFNV (SEQ ID NO: 307)

KCYFLRKAKAKQMPVEMSRPAVPLLNSNNEKMSDPNMEANSHYGHNDDVR

NHAMKPINDNKEPLNSD (SEQ ID NO: 18)

RRHQGKQNELSDTAGREINLVDAHLKSEQTEASTRQNSQVLLSETGIYDN

DPDLCFRMQEGSEVYSNPCLEENKPG (SEQ ID NO: 20)

WRMMKYQQKAAGMSPEQVLQPLEGDLCYADLTLQLAGTSPQKATTKLSSA

QVDQVEVEYVTMASLPKED (SEQ ID NO: 347)

KRVQETKFGNAFTEEDSELVVNYIAKKSFCRRAIELTLHSLGVSEELQNK

LEDVVIDRNLLILGKILGEGEFGSVMEGNLKQEDGTSLKVAVKTMKLDNS

SQREIEEFLSEAACMKDFSHPNVIRLLGVCIEMSSQGIPKPMVILPFMKY

GDLHTY (SEQ ID NO: 26)

(b) a naturally occurring N-terminal flanking region of ITIM.*ITSM intracellular domains selected from

YKMYGSEMLHKRDPLDEDEDTD (SEQ ID NO: 4)

WRMMKYQQKAAGMSPEQVLQPLEGD (SEQ ID NO: 6)

CSRAARGTIGARRTGQPLKEDPSAVPVFS (SEQ ID NO: 7)

RIRQKKAQGSTSSTRLHEPEKNAREITQDTND (SEQ ID NO: 8)

KTHRRKAARTAVGRNDTHPTTGSASPKHQKKSKLHGPTETSSCSGAAPTV

EMDEE (SEQ ID NO: 12)

KCYFLRKAKAKQMPVEMSRPAVPLLNSNNEKMSDPNMEANSHYGHNDDVR

NHAMKPINDNKEPLNSD (SEQ ID NO: 18)

RRHQGKQNELSDTAGREINLVDAHLKSEQTEASTRQNSQVLLSETGIYDN

DPDLCFRMQEGSEVYSNPCLEENKPG (SEQ ID NO: 20)

KRVQETKFGNAFTEEDSELVVNYIAKKSFCRRAIELTLHSLGVSEELQNK

LEDVVIDRNLLILGKILGEGEFGSVMEGNLKQEDGTSLKVAVKTMKLDNS

SQREIEEFLSEAACMKDFSHPNVIRLLGVCIEMSSQGIPKPMVILPFMKY

GDLHTY (SEQ ID NO: 26)

(c) a naturally occurring intracellular domain from a known inhibitory receptor selected from the sequences shown in table 2, wherein said intracellular domain is N-terminally flanking to a sequence in (b) above; and
(d) a non-naturally occurring sequence comprising between 1 and 500 amino acids.

In some embodiments, each of L2 and L3 is absent or comprises one or more, preferably one, sequences selected from the group consisting of:
(e) a naturally occurring C-terminal flanking region of ITIM only intracellular domains selected from;

GNCSFFTETG (SEQ ID NO: 423)

NFHGMNPSKDTSTEYSEVRTQ (SEQ ID NO: 485)

KEEEMADTSYGTVKAENIIMMETAQTSL (SEQ ID NO: 521)

NHSVIGPNSRLARNVKEAPTEYASICVRS (SEQ ID NO: 525)

DHWALTQRTARAVSPQSTKPMAESITYAAVARH (SEQ ID NO: 529)

QVSSAESHKDLGKKDTETVYSEVRKAVPDAVESRYSRTEGSLDGT
(SEQ ID NO: 576)

DFQWREKTPEPPVPCVPEQTEYATIVFPSGMGTSSPARRGSADGPRSAQP

LRPEDGHCSWPL (SEQ ID NO: 611)

NLPKGKKPAPQAAEPNNHTEYASIQTSPQPASEDTLTYADLDMVHLNRTP

KQPAPKPEPSFSEYASVQVPRK (SEQ ID NO: 683)

TLQLAGTSPQKATTKLSSAQVDQVEVEYVTMASLPKEDISYASLTLGAED

QEPTYCNMGHLSSHLPGRGPEEPTEYSTISRP (SEQ ID NO: 684)

ETGPKHIPLQTLLKFMVDIALGMEYLSNRNFLHRDLAARNCMLRDDMTVC

VADFGLSKKIYSGDYYRQGRIAKMPVKWIAIESLADRVYTSKSDVWAFGV

TMWEIATRGMTPYPGVQNHEMYDYLLHGHRLKQPEDCLDELYEIMYSCWR

TDPLDRPTFSVLRLQLEKLLESLPDVRNQADVIYVNTQLLESSEGLAQGS

TLAPLDLNIDPDSIIASCTPRAAISVVTAEVHDSKPHEGRYILNGGSEEW

EDLTSAPSAAVTAEKNSVLPGERLVRNGVSWSHSSMLPLGSSLPDELLFA

DDSSEGSEVLM (SEQ ID NO: 685)

(f) a naturally occurring N-terminal flanking region of ITSM only intracellular domains selected from;

YKMYGSEMLHKRDPLDEDEDTDISYKKLKEEEMAD
(SEQ ID NO: 739)

CSRAARGTIGARRTGQPLKEDPSAVPVFSVDYGELDFQWREKTPEPPVPC

VPEQ (SEQ ID NO: 741)

RIRQKKAQGSTSSTRLHEPEKNAREITQDTNDITYADLNLPKGKKPAPQA

AEPNNH (SEQ ID NO: 743)

KTHRRKAARTAVGRNDTHPTTGSASPKHQKKSKLHGPTETSSCSGAAPTV

EMDEELHYASLNFHGMNPSKDTS (SEQ ID NO: 753)

KCYFLRKAKAKQMPVEMSRPAVPLLNSNNEKMSDPNMEANSHYGHNDDVR

NHAMKPINDNKEPLNSDVQYTEVQVSSAESHKDLGKKDTE
(SEQ ID NO: 765)

RRHQGKQNELSDTAGREINLVDAHLKSEQTEASTRQNSQVLLSETGIYDN

DPDLCFRMQEGSEVYSNPCLEENKPGIVYASLNHSVIGPNSRLARNVKEA

P (SEQ ID NO: 768)

WRMMKYQQKAAGMSPEQVLQPLEGDLCYADLTLQLAGTSPQKATTKLSSA

QVDQVEVEYVTMASLPKEDISYASLTLGAEDQEPTYCNMGHLSSHLPGRG

PEEP (SEQ ID NO: 771)

WRRKRKEKQSETSPKEFLTIYEDVKDLKTRRNHEQEQTFPGGGSTIYSMI

QSQSSAPTSQEPAYTLYSLIQPSRKSGSRKRNHSPSFNS
(SEQ ID NO: 780)

VRSCRKKSARPAAGVGDTGIEDANAVRGSASQGPLTEPWAEDSPPDQPPP

ASARSSVGEGELQYASLSFQMVKPWDSRGQEATD (SEQ ID NO: 759)

NKCGRRNKFGINRPAVLAPEDGLAMSLHFMTLGGSSLSPTEGKGSGLQGH

IIENPQYFSDACVHHIKRRDIVLKWELGEGAFGKVFLAECHNLLPEQDKM

LVAVKALKEASESARQDFQREAELLTMLQHQHIVRFFGVCTEGRPLLMVF

EYMRHGDLNRFLRSHGPDAKLLAGGEDVAPGPLGLGQLLAVASQVAAGMV

YLAGLHFVHRDLATRNCLVGQGLVVKIGDFGMSRDIYS
(SEQ ID NO: 782)

KLARHSKFGMKGPASVISNDDDSASPLHHISNGSNTPSSSEGGPDAVIIG

MTKIPVIENPQYFGITNSQLKPDTFVQHIKRHNIVLKRELGEGAFGKVFL

AECYNLCPEQDKILVAVKTLKDASDNARKDFHREAELLTNLQHEHIVKFY

GVCVEGDPLIMVFEYMKHGDLNKFLRAHGPDAVLMAEGNPPTELTQSQML

HIAQQIAAGMVYLASQHFVHRDLATRNCLVGENLLVKIGDFGMSRDVYS
(SEQ ID NO: 783)

KRKGRCSVPAFCSSQAEAPADTPEPTAGHTLYSVLSQGYEKLDTPLRPAR

QQPTPTSDSSSDSNLTTEEDEDRPEVHKPISGRYEVFDQVTQEGAGHDPA

PEGQADYDPVTPYVTEVESVVGENTMYAQVFNLQGKTPVSQKEESSA
(SEQ ID NO: 786)

KRVQETKFGNAFTEEDSELVVNYIAKKSFCRRAIELTLHSLGVSEELQNK

LEDVVIDRNLLILGKILGEGEFGSVMEGNLKQEDGTSLKVAVKTMKLDNS

SQREIEEFLSEAACMKDFSHPNVIRLLGVCIEMSSQGIPKPMVILPFMKY

GDLHTYLLYSRLETGPKHIPLQTLLKFMVDIALGMEYLSNRNFLHRDLAA

RNCMLRDDMTVCVADFGLSKKIYSGDYYRQGRIAKMPVKWIAIESLADRV

YTSKSDVWAFGVTMWEIATRGM (SEQ ID NO: 787)

(g) a naturally occurring intracellular domain between ITIM and ITSM from proteins that have ITIM.*ITSM motif selected from;

KEEEMAD (SEQ ID NO: 686)

NFHGMNPSKDTS (SEQ ID NO: 687)

QVSSAESHKDLGKKDTE (SEQ ID NO: 691)

NLPKGKKPAPQAAEPNNH (SEQ ID NO: 694)

NHSVIGPNSRLARNVKEAP (SEQ ID NO: 695)

DFQWREKTPEPPVPCVPEQ (SEQ ID NO: 696)

TLQLAGTSPQKATTKLSSAQVDQVEVEYVTMASLPKEDISYASLTLGAED

QEPTYCNMGHLSSHLPGRGPEEP (SEQ ID NO: 703)

ETGPKHIPLQTLLKFMVDIALGMEYLSNRNFLHRDLAARNCMLRDDMTVC

VADFGLSKKIYSGDYYRQGRIAKMPVKWIAIESLADRVYTSKSDVWAFGV

TMWEIATRGM (SEQ ID NO: 707)

(h) a naturally occurring intracellular domain from known inhibitory receptors selected from the sequences shown in table 2 wherein said intracellular domain is N-terminally flanking to a sequence in (f) or (g) above; and
(i) a non-naturally occurring sequence comprising between 1 and 500 amino acids.

In some embodiments, L4 is absent or comprises one or more, preferably one, sequences selected from the group consisting of:

(j) a naturally occurring C-terminal flanking region of ITIM.*ITSM intracellular domains selected from:

SRP

RTQ

CVRS (SEQ ID NO: 808)

KAENIIMMETAQTSL (SEQ ID NO: 809)

RKAVPDAVESRYSRTEGSLDGT (SEQ ID NO: 812)

VFPSGMGTSSPARRGSADGPRSAQPLRPEDGHCSWPL
(SEQ ID NO: 815)

```
QTSPQPASEDTLTYADLDMVHLNRTPKQPAPKPEPSFSEYASVQVPRK
(SEQ ID NO: 2028)

QNHEMYDYLLHGHRLKQPEDCLDELYEIMYSCWRTDPLDRPTFSVLRLQL
(SEQ ID NO: 2029)

EKLLESLPDVRNQADVIYVNTQLLESSEGLAQGSTLAPLDLNIDPDSIIA
(SEQ ID NO: 817)

SCTPRAAISVVTAEVHDSKPHEGRYILNGGSEEWEDLTSAPSAAVTAEKN
(SEQ ID NO: 818)

SVLPGERLVRNGVSWSHSSMLPLGSSLPDELLFADDSSEGSEVLM
(SEQ ID NO: 876)
```

(k) a naturally occurring C-terminal flanking region of ITSM only intracellular domain selected from

```
RTQ

SRP

KIHR (SEQ ID NO: 808)

CVRS (SEQ ID NO: 809)

KAENIIMMETAQTSL (SEQ ID NO: 812)

RKAVPDAVESRYSRTEGSLDGT (SEQ ID NO: 815)

RKPQVVPPPQQNDLEIPESPTYENFT (SEQ ID NO: 2028)

GKSQPKAQNPARLSRKELENFDVYS (SEQ ID NO: 2029)

VFPSGMGTSSPARRGSADGPRSAQPLRPEDGHCSWPL
(SEQ ID NO: 817)

QTSPQPASEDTLTYADLDMVHLNRTPKQPAPKPEPSFSEYASVQVPRK
(SEQ ID NO: 818)

FNLQGKTPVSQKEESSATIYCSIRKPQVVPPPQQNDLEIPESPTYENFT
(SEQ ID NO: 876)

GGRTMLPIRWMPPESILYRKFTTESDVWSFGVVLWEIFTYGKQPWYQLSN

TEAIDCITQGRELERPRACPPEVYAIMRGCWQREPQQRHSIKDVHARLQA

LAQAPPVYLDVLG (SEQ ID NO: 888)

GGHTMLPIRWMPPESIMYRKFTTESDVWSLGVVLWEIFTYGKQPWYQLSN

NEVIECITQGRVLQRPRTCPQEVYELMLGCWQREPHMRKNIKGIHTLLQN

LAKASPVYLDILG (SEQ ID NO: 889)

QNHEMYDYLLHGHRLKQPEDCLDELYEIMYSCWRTDPLDRPTFSVLRLQL

EKLLESLPDVRNQADVIYVNTQLLESSEGLAQGSTLAPLDLNIDPDSIIA

SCTPRAAISVVTAEVHDSKPHEGRYILNGGSEEWEDLTSAPSAAVTAEKN

SVLPGERLVRNGVSWSHSSMLPLGSSLPDELLFADDSSEGSEVLM
(SEQ ID NO: 830)

KDLKTRRNHEQEQTFPGGGSTIYSMIQSQSSAPTSQEPAYTLYSLIQPSR

KSGSRKRNHSPSFNSTIYEVIGKSQPKAQNPARLSRKELENFDVYS
(SEQ ID NO: 902)
```

(l) a naturally occurring intracellular domain from a known inhibitory receptor selected from the sequences shown in table 2 wherein said intracellular domain is C-terminally flanking to a sequence in (j) or (k) above; and (m) a non-naturally occurring sequence comprising between 1 and 500 amino acids.

In some embodiments the intracellular domain comprises the sequence (L3-ITSM-L4)$^m$ (i.e, n is 0 and p is 1).

In some embodiments, the intracellular domain comprises the sequence L3-ITSM-L4 (i.e, n is 0, m is 1 and p is 1).

In some embodiments, the intracellular domain comprises the sequence L3-ITSM-L4-L3-ITSM-L4 (i.e, n is 0, m is 2 and p is 1).

In some embodiments, the intracellular domain comprises the following sequence: ((L1-ITIM-L2)$^n$-(L3-ITSM-L4)$^m$)$^p$, wherein n is 0;

m is 1;

p is 1;

L3 comprises one sequence selected from (f) a naturally occurring N-terminal flanking region of an ITSM only intracellular domain such as, for example, any of the sequences shown in Table 6 below or a fragment thereof; or, (i) a non-naturally occurring sequence comprising between 1 and 500 amino acids; and L4 comprises one or more, preferably one or two, sequences selected from the group consisting of:

(k) a naturally occurring C-terminal flanking region of an ITSM only intracellular domain such as, for example, any of the sequences shown in Table 8 below or a fragment thereof;

(l) a naturally occurring intracellular domain from a known inhibitory receptor such as any of the sequences shown in table 2 or a fragment thereof wherein said intracellular domain is C-terminally flanking to a sequence in (k) above; and (m) a non-naturally occurring sequence comprising between 1 and 500 amino acids, and, wherein, the ITSM is the sequence $TX_1YX_2X_3X_4$ (SEQ ID NO: 2049), wherein $X_1$ is an amino acid, $X_2$ is an amino acid, $X_3$ is an amino acid, and, $X_4$ is V or I, or a variant thereof.

In some embodiments, the intracellular domain comprises the following sequence:

((L1-ITIM-L2)$^n$-(L3-ITSM-L4)$^m$)$^p$, wherein n is 0;

m is 1;

p is 1;

L3 is selected from

```
YKMYGSEMLHKRDPLDEDEDTDISYKKLKEEEMAD
(SEQ ID NO: 739)

CSRAARGTIGARRTGQPLKEDPSAVPVFSVDYGELDFQWREKTPEPPVPC

VPEQ (SEQ ID NO: 741)

RIRQKKAQGSTSSTRLHEPEKNAREITQDTNDITYADLNLPKGKKPAPQA

AEPNNH (SEQ ID NO: 743)

KTHRRKAARTAVGRNDTHPTTGSASPKHQKKSKLHGPTETSSCSGAAPTV

EMDEELHYASLNFHGMNPSKDTS (SEQ ID NO: 753)

KCYFLRKAKAKQMPVEMSRPAVPLLNSNNEKMSDPNMEANSHYGHNDDVR

NHAMKPINDNKEPLNSDVQYTEVQVSSAESHKDLGKKDTE
(SEQ ID NO: 765)
```

RRHQGKQNELSDTAGREINLVDAHLKSEQTEASTRQNSQVLLSETGIYDN
DPDLCFRMQEGSEVYSNPCLEENKPGIVYASLNHSVIGPNSRLARNVKEA
P (SEQ ID NO: 768)

WRMMKYQQKAAGMSPEQVLQPLEGDLCYADLTLQLAGTSPQKATTKLSSA
QVDQVEVEYVTMASLPKEDISYASLTLGAEDQEPTYCNMGHLSSHLPGRG
PEEP (SEQ ID NO: 771)

WRRKRKEKQSETSPKEFLTIYEDVKDLKTRRNHEQEQTFPGGGSTIYSMI
SQSSAPTSQEPAYTLYSLIQPSRKSGSRKRNHSPSFNS
(SEQ ID NO: 780)

VRSCRKKSARPAAGVGDTGIEDANAVRGSASQGPLTEPWAEDSPPDQPPP
ASARSSVGEGELQYASLSFQMVKPWDSRGQEATD (SEQ ID NO: 759)

NKCGRRNKFGINRPAVLAPEDGLAMSLHFMTLGGSSLSPTEGKGSGLQGH
IIENPQYFSDACVHHIKRRDIVLKWELGEGAFGKVFLAECHNLLPEQDKM
LVAVKALKEASESARQDFQREAELLTMLQHQHIVRFFGVCTEGRPLLMVF
EYMRHGDLNRFLRSHGPDAKLLAGGEDVAPGPLGLGQLLAVASQVAAGMV
YLAGLHFVHRDLATRNCLVGQGLVVKIGDFGMSRDIYS
(SEQ ID NO: 782)

KLARHSKFGMKGPASVISNDDDSASPLHHISNGSNTPSSSEGGPDAVIIG
MTKIPVIENPQYFGITNSQLKPDTFVQHIKRHNIVLKRELGEGAFGKVFL
AECYNLCPEQDKILVAVKTLKDASDNARKDFHREAELLTNLQHEHIVKFY
GVCVEGDPLIMVFEYMKHGDLNKFLRAHGPDAVLMAEGNPPTELTQSQML
HIAQQIAAGMVYLASQHFVHRDLATRNCLVGENLLVKIGDFGMSRDVYS
(SEQ ID NO: 783)

KRKGRCSVPAFCSSQAEAPADTPEPTAGHTLYSVLSQGYEKLDTPLRPAR
QQPTPTSDSSSDSNLTTEEDEDRPEVHKPISGRYEVFDQVTQEGAGHDPA
PEGQADYDPVTPYVTEVESVVGENTMYAQVFNLQGKTPVSQKEESSA
(SEQ ID NO: 786)

KRVQETKFGNAFTEEDSELVVNYIAKKSFCRRAIELTLHSLGVSEELQNK
LEDVVIDRNLLILGKILGEGEFGSVMEGNLKQEDGTSLKVAVKTMKLDNS
SQREIEEFLSEAACMKDFSHPNVIRLLGVCIEMSSQGIPKPMVILPFMKY
GDLHTYLLYSRLETGPKHIPLQTLLKFMVDIALGMEYLSNRNFLHRDLAA
RNCMLRDDMTVCVADFGLSKKIYSGDYYRQGRIAKMPVKWIAIESLADRV
YTSKSDVWAFGVTMWEIATRGM (SEQ ID NO: 787)

and L4 comprises one sequence selected from the group consisting of
(k)

RTQ

SRP

KIHR (SEQ ID NO: 808)

CVRS (SEQ ID NO: 809)

KAENIIMMETAQTSL (SEQ ID NO: 812)

RKAVPDAVESRYSRTEGSLDGT (SEQ ID NO: 815)

RKPQVVPPPQQNDLEIPESPTYENFT (SEQ ID NO: 2028)

GKSQPKAQNPARLSRKELENFDVYS (SEQ ID NO: 2029)

VFPSGMGTSSPARRGSADGPRSAQPLRPEDGHCSWPL
(SEQ ID NO: 817)

QTSPQPASEDTLTYADLDMVHLNRTPKQPAPKPEPSFSEYASVQVPRK
(SEQ ID NO: 818)

FNLQGKTPVSQKEESSATIYCSIRKPQVVPPPQQNDLEIPESPTYENFT
(SEQ ID NO: 876)

GGRTMLPIRWMPPESILYRKFTTESDVWSFGVVLWEIFTYGKQPWYQLSN
EAIDCITQGRELERPRACPPEVYAIMRGCWQREPQQRHSIKDVHARLQAL
AQAPPVYLDVLG (SEQ ID NO: 888)

GGHTMLPIRWMPPESIMYRKFTTESDVWSLGVVLWEIFTYGKQPWYQLSN
NEVIECITQGRVLQRPRTCPQEVYELMLGCWQREPHMRKNIKGIHTLLQN
LAKASPVYLDILG (SEQ ID NO: 889)

QNHEMYDYLLHGHRLKQPEDCLDELYEIMYSCWRTDPLDRPTFSVLRLQL
EKLLESLPDVRNQADVIYVNTQLLESSEGLAQGSTLAPLDLNIDPDSIIA
SCTPRAAISVVTAEVHDSKPHEGRYILNGGSEEWEDLTSAPSAAVTAEKN
SVLPGERLVRNGVSWSHSSMLPLGSSLPDELLFADDSSEGSEVLM
(SEQ ID NO: 830)

KDLKTRRNHEQEQTFPGGGSTIYSMIQSQSSAPTSQEPAYTLYSLIQPSR
KSGSRKRNHSPSFNSTIYEVIGKSQPKAQNPARLSRKELENFDVYS
(SEQ ID NO: 902)

and optionally
(l) a naturally occurring intracellular domain from a known inhibitory receptor such as any of the sequences shown in table 2 or a fragment thereof wherein said intracellular domain is C-terminally flanking to a sequence in (k) above;

and the ITSM is the sequence $TX_1YX_2X_3X_4$ (SEQ ID NO: 2049), wherein $X_1$ is an amino acid, $X_2$ is an amino acid, $X_3$ is an amino acid, and, $X_4$ is V or I, or a variant thereof.

In some embodiments, the intracellular domain comprises the following sequence: $((L1\text{-}ITIM\text{-}L2)^n\text{-}(L3\text{-}ITSM\text{-}L4)^m)^p$, wherein n is 0;

m is 1;

p is 1;

L3 is selected from

CSRAARGTIGARRTGQPLKEDPSAVPVFSVDYGELDFQWREKTPEPPVPC
VPEQ (SEQ ID NO: 741)

RIRQKKAQGSTSSTRLHEPEKNAREITQDTNDITYADLNLPKGKKPAPQA
AEPNNH (SEQ ID NO: 743)

KCYFLRKAKAKQMPVEMSRPAVPLLNSNNEKMSDPNMEANSHYGHNDDVR
NHAMKPINDNKEPLNSDVQYTEVQVSSAESHKDLGKKDTE
(SEQ ID NO: 765)

-continued

RRHQGKQNELSDTAGREINLVDAHLKSEQTEASTRQNSQVLLSETGIYDN

DPDLCFRMQEGSEVYSNPCLEENKPGIVYASLNHSVIGPNSRLARNVKEA

P (SEQ ID NO: 768)

WRMMKYQQKAAGMSPEQVLQPLEGDLCYADLTLQLAGTSPQKATTKLSSA

QVDQVEVEYVTMASLPKEDISYASLTLGAEDQEPTYCNMGHLSSHLPGRG

PEEP (SEQ ID NO: 771)

WRRKRKEKQSETSPKEFLTIYEDVKDLKTRRNHEQEQTFPGGGSTIYSMI

QSQSSAPTSQEPAYTLYSLIQPSRKSGSRKRNHSPSFNS
(SEQ ID NO: 780)

VRSCRKKSARPAAGVGDTGIEDANAVRGSASQGPLTEPWAEDSPPDQPPP

SARSSVGEGELQYASLSFQMVKPWDSRGQEATD (SEQ ID NO: 759)

KRKGRCSVPAFCSSQAEAPADTPEPTAGHTLYSVLSQGYEKLDTPLRPAR

QQPTPTSDSSSDSNLTTEEDEDRPEVHKPISGRYEVFDQVTQEGAGHDPA

PEGQADYDPVTPYVTEVESVVGENTMYAQVFNLQGKTPVSQKEESSA
(SEQ ID NO: 786)

L4 comprises one sequence selected from the group consisting of
(k)

SRP

KIHR (SEQ ID NO: 808)

CVRS (SEQ ID NO: 809)

RKAVPDAVESRYSRTEGSLDGT (SEQ ID NO: 815)

RKPQVVPPPQQNDLEIPESPTYENFT (SEQ ID NO: 2028)

GKSQPKAQNPARLSRKELENFDVYS (SEQ ID NO: 2029)

VFPSGMGTSSPARRGSADGPRSAQPLRPEDGHCSWPL
(SEQ ID NO: 817)

QTSPQPASEDTLTYADLDMVHLNRTPKQPAPKPEPSFSEYASVQVPRK
(SEQ ID NO: 818)

and optionally
(l) a naturally occurring intracellular domain from a known inhibitory receptor selected from the sequences shown in table 2 or a fragment thereof wherein said intracellular domain is C-terminally flanking to a sequence in (k) above;
and the ITSM is the sequence $TX_1YX_2X_3X_4$ (SEQ ID NO: 2049), wherein
$X_1$ is an amino acid,
$X_2$ is an amino acid,
$X_3$ is an amino acid, and,
$X_4$ is V or I,
or a variant thereof.

In some embodiments, the intracellular domain comprises the following sequence: $((L1\text{-}ITIM\text{-}L2)^n\text{-}(L3\text{-}ITSM\text{-}L4)^m)^p$, wherein
n is 0;
m is 1;
p is 1;
L3 is selected from

CSRAARGTIGARRTGQPLKEDPSAVPVFSVDYGELDFQWREKTPEPPVPC

VPEQ (SEQ ID NO: 741)

and L4 comprises
(k)

VFPSGMGTSSPARRGSADGPRSAQPLRPEDGHCSWPL
(SEQ ID NO: 817)

and
(l) a naturally occurring intracellular domain from a known inhibitory receptor selected from the sequences shown in table 2 or a fragment thereof wherein said intracellular domain is C-terminally flanking to a sequence in (k) above;
and the ITSM is the sequence $TX_1YX_2X_3X_4$ (SEQ ID NO: 2049), wherein
$X_1$ is an amino acid,
$X_2$ is an amino acid,
$X_3$ is an amino acid, and,
$X_4$ is V or I,
or a variant thereof.

In some embodiments, the intracellular domain comprises the following sequence: $((L1\text{-}ITIM\text{-}L2)^n\text{-}(L3\text{-}ITSM\text{-}L4)^m)^p$, wherein
n is 0;
m is 1;
p is 1;
L3 is selected from

WRMMKYQQKAAGMSPEQVLQPLEGDLCYADLTLQLAGTSPQKATTKLSSA

QVDQVEVEYVTMASLPKEDISYASLTLGAEDQEPTYCNMGHLSSHLPGRG

PEEP (SEQ ID NO: 771)

L4 comprises
(k)

SRP and optionally
(l) a naturally occurring intracellular domain from a known inhibitory receptor selected from the sequences shown in table 2 or a fragment thereof wherein said intracellular domain is C-terminally flanking to a sequence in (k) above;
and the ITSM is the sequence $TX_1YX_2X_3X_4$ (SEQ ID NO: 2049), wherein
$X_1$ is an amino acid,
$X_2$ is an amino acid,
$X_3$ is an amino acid, and,
$X_4$ is V or I,
or a variant thereof.

In some embodiments, the intracellular domain comprises the following sequence:

((L1-ITIM-L2)$^n$-(L3-ITSM-L4)$^m$)$^p$, wherein
n is 0;
m is 1;
p is 1 or 2;
L3 comprises one sequence selected from
(i) a non-naturally occurring sequence comprising between 1 and 500 amino acids; and
L4 comprises one or more, preferably one or two, sequences selected from:
(m) a non-naturally occurring sequence comprising between 1 and 500 amino acids, and, wherein,
the ITSM is the sequence TX$_1$YX$_2$X$_3$X$_4$ (SEQ ID NO: 2049), wherein
X$_1$ is an amino acid,
X$_2$ is an amino acid,
X$_3$ is an amino acid, and,
X$_4$ is V or I.

In some embodiments, the intracellular domain comprises the sequence (L1-ITIM-L2-L3-ITSM-L4)$^p$ wherein
p is 1, 2, 3, 4 or 5;
L1 is a naturally occurring N-terminal flanking region of an ITIM only intracellular domain or a fragment thereof such as, for example, any of the sequences shown in Table 3 below or a fragment thereof;
L2 is absent;
L3 is a naturally occurring intracellular domain between ITIM and ITSM from proteins that have ITIM.*ITSM motif or a fragment thereof such as, for example, any of the sequences shown in Table 5 below or a fragment thereof;
L4 is a naturally occurring C-terminal flanking region of an ITIM.*ITSM intracellular domain or a fragment thereof such as, for example, any of the sequences shown in Table 7 below or a fragment thereof; or a naturally occurring C-terminal flanking region of ITSM only intracellular domain or a fragment thereof such as, for example, any of the sequences shown in Table 8 below or a fragment thereof.

In some embodiments, the intracellular domain comprises the sequence (L1-ITIM-L2-L3-ITSM-L4)$^p$ wherein
p is 1, 2, 3, 4 or 5;
L1 is a naturally occurring N-terminal flanking region of ITIM only intracellular domains selected from the following sequences;

YKMYGSEMLHKRDPLDEDEDTD (SEQ ID NO: 4)

DHWALTQRTARAVSPQSTKPMAES (SEQ ID NO: 194)

CSRAARGTIGARRTGQPLKEDPSAVPVFS (SEQ ID NO: 7)

HRQNQIKQGPPRSKDEEQKPQQRPDLAVDVLERTADKATVNGLPEKDRET

DTSALAAGSSQE (SEQ ID NO: 268)

KTHRRKAARTAVGRNDTHPTTGSASPKHQKKSKLHGPTETSSCSGAAPTV

EMDEE (SEQ ID NO: 12)

LTRKKKALRIHSVEGDLRRKSAGQEEWSPSAPSPPGSCVQAEAAPAGLCG

EQRGEDCAELHDYFNV (SEQ ID NO: 307)

KCYFLRKAKAKQMPVEMSRPAVPLLNSNNEKMSDPNMEANSHYGHNDDVR

NHAMKPINDNKEPLNSD (SEQ ID NO: 18)

RRHQGKQNELSDTAGREINLVDAHLKSEQTEASTRQNSQVLLSETGIYDN

DPDLCFRMQEGSEVYSNPCLEENKPG (SEQ ID NO: 20)

WRMMKYQQKAAGMSPEQVLQPLEGDLCYADLTLQLAGTSPQKATTKLSSA

QVDQVEVEYVTMASLPKED (SEQ ID NO: 347)

KRVQETKFGNAFTEEDSELVVNYIAKKSFCRRAIELTLHSLGVSEELQNK

LEDVVIDRNLLILGKILGEGEFGSVMEGNLKQEDGTSLKVAVKTMKLDNS

SQREIEEFLSEAACMKDFSHPNVIRLLGVCIEMSSQGIPKPMVILPFMKY

GDLHTY (SEQ ID NO: 26)

L2 is absent;

L3 is a naturally occurring intracellular domain between ITIM and ITSM from proteins that have ITIM.*ITSM motif selected from the following sequences:

KEEEMAD (SEQ ID NO: 686)

NFHGMNPSKDTS (SEQ ID NO: 687)

QVSSAESHKDLGKKDTE (SEQ ID NO: 691)

NLPKGKKPAPQAAEPNNH (SEQ ID NO: 694)

NHSVIGPNSRLARNVKEAP (SEQ ID NO: 695)

DFQWREKTPEPPVPCVPEQ (SEQ ID NO: 696)

TLQLAGTSPQKATTKLSSAQVDQVEVEYVTMASLPKEDISYASLTLGAED

QEPTYCNMGHLSSHLPGRGPEEP (SEQ ID NO: 703)

ETGPKHIPLQTLLKFMVDIALGMEYLSNRNFLHRDLAARNCMLRDDMTVC

VADFGLSKKIYSGDYYRQGRIAKMPVKWIAIESLADRVYTSKSDVWAFGV

TMWEIATRGM (SEQ ID NO: 707)

L4 is a naturally occurring C-terminal flanking region of ITIM.*ITSM intracellular domains selected from the following sequences:

SRP

RTQ

CVRS (SEQ ID NO: 809)

KAENIIMMETAQTSL (SEQ ID NO: 812)

RKAVPDAVESRYSRTEGSLDGT (SEQ ID NO: 815)

VFPSGMGTSSPARRGSADGPRSAQPLRPEDGHCSWPL
(SEQ ID NO: 817)

QTSPQPASEDTLTYADLDMVHLNRTPKQPAPKPEPSFSEYASVQVPRK
(SEQ ID NO: 818)

QNHEMYDYLLHGHRLKQPEDCLDELYEIMYSCWRTDPLDRPTFSVLRLQL

EKLLESLPDVRNQADVIYVNTQLLESSEGLAQGSTLAPLDLNIDPDSIIA

SCTPRAAISVVTAEVHDSKPHEGRYILNGGSEEWEDLTSAPSAAVTAEKN

SVLPGERLVRNGVSWSHSSMLPLGSSLPDELLFADDSSEGSEVLM
(SEQ ID NO: 830)

or a naturally occurring C-terminal flanking region of ITSM only intracellular domains selected from the following sequences:

RTQ

SRP

CVRS (SEQ ID NO: 809)

KAENIIMMETAQTSL (SEQ ID NO: 812)

RKAVPDAVESRYSRTEGSLDGT (SEQ ID NO: 815)

VFPSGMGTSSPARRGSADGPRSAQPLRPEDGHCSWPL (SEQ ID NO: 817)

QTSPQPASEDTLTYADLDMVHLNRTPKQPAPKPEPSFSEYASVQVPRK (SEQ ID NO: 818)

FNLQGKTPVSQKEESSATIYCSIRKPQVVPPPQQNDLEIPESPTYENFT (SEQ ID NO: 876)

GGRTMLPIRWMPPESILYRKFTTESDVWSFGVVLWEIFTYGKQPWYQLSN

TEAIDCITQGRELERPRACPPEVYAIMRGCWQREPQQRHSIKDVHARLQA

LAQAPPVYLDVLG (SEQ ID NO: 888)

GGHTMLPIRWMPPESIMYRKFTTESDVWSLGVVLWEIFTYGKQPWYQLSN

NEVIECITQGRVLQRPRTCPQEVYELMLGCWQREPHMRKNIKGIHTLLQN

LAKASPVYLDILG (SEQ ID NO: 889)

QNHEMYDYLLHGHRLKQPEDCLDELYEIMYSCWRTDPLDRPTFSVLRLQL

EKLLESLPDVRNQADVIYVNTQLLESSEGLAQGSTLAPLDLNIDPDSIIA

SCTPRAAISVVTAEVHDSKPHEGRYILNGGSEEWEDLTSAPSAAVTAEKN

SVLPGERLVRNGVSWSHSSMLPLGSSLPDELLFADDSSEGSEVLM (SEQ ID NO: 830)

KDLKTRRNHEQEQTFPGGGSTIYSMIQSQSSAPTSQEPAYTLYSLIQPSR

KSGSRKRNHSPSFNSTIYEVIGKSQPKAQNPARLSRKELENFDVYS (SEQ ID NO: 902).

or a variant thereof.

In some embodiments, the non-naturally occurring sequence of (d), (i) and (m) comprises between 1 and 500 amino acids, preferably 1 to 400, 1 to 300, 1 to 200, 1 to 100, 10 to 100, 10 to 80, 10 to 60, 10 to 40, 100 to 200, 100 to 300 or 100 to 400.

In some embodiments, the non-naturally occurring sequence of (d) or (i) is a Glycine/Serine linker $(Gly_xSer)_n$ where x=1, 2, 3, 4 or 5 and n is 1 to 100 (SEQ ID NO: 2037). Preferably the Glycine/Serine linker comprises the amino acid sequence $(Gly-Gly-Gly-Ser)_n$ (SEQ ID NO: 2030) or $(Gly-Gly-Gly-Gly-Ser)_n$ (SEQ ID NO: 2031), where n is a positive integer equal to or greater than 1, preferably between 1 to 100, 1 to 80, 1 to 50, 1 to 20 or 1 to 10. For example, n=1, n=2, n=3, n=4, n=5, n=6, n=7, n=8, n=9 and n=10. In one embodiment, the glycine/serine linkers include, but are not limited to, $(Gly_4Ser)_4$ (SEQ ID NO: 2032) or $(Gly_4Ser)_3$ (SEQ ID NO: 2033).

In some embodiments, $X_1$ is E, V or I.
In some embodiments, $X_1$ is E.
In some embodiments, $X_2$ is S or A.
In some embodiments, $X_2$ is A.
In some embodiments, $X_3$ is E, S, T, Q or V.
In some embodiments, $X_3$ is E.
In some embodiments, $X_3$ is T.
In some embodiments, $X_2$ is I.

In some embodiments, $X_5$ is L, V or I.
In some embodiments, $X_5$ is L.
In some embodiments, $X_5$ is V.
In some embodiments, $X_5$ is I.
In some embodiments, $X_6$ is A, H, Q, T, D, V, L or E.
In some embodiments, $X_6$ is H.
In some embodiments, $X_6$ is D.
In some embodiments, $X_7$ is A, G, T, V or E.
In some embodiments, $X_7$ is A.
In some embodiments, $X_7$ is G.
In some embodiments, $X_8$ is V, S, D or E.
In some embodiments, $X_8$ is S or E.
In some embodiments, $X_8$ is E.
In some embodiments, $X_9$ is L or V.
In some embodiments, $X_9$ is L.
In some embodiments, $X_5$ is L or V, $X_8$ is E and $X_9$ is L.

In some embodiments, the ITSM, or at least one of the ITSMs when several ITSMs are present in the intracellular domain, is selected from SEQ ID No 926 to SEQ ID No 1015 (see below table).

| | |
|---|---|
| TAYELV | SEQ ID No 926 |
| TAYGLI | SEQ ID No 927 |
| TAYNAV | SEQ ID No 928 |
| TCYGLV | SEQ ID No 929 |
| TCYPDI | SEQ ID No 930 |
| TDYASI | SEQ ID No 931 |
| TDYDLV | SEQ ID No 932 |
| TDYLSI | SEQ ID No 933 |
| TDYQQV | SEQ ID No 934 |
| TDYYRV | SEQ ID No 935 |
| TEYASI | SEQ ID No 936 |
| TEYATI | SEQ ID No 937 |
| TEYDTI | SEQ ID No 938 |
| TEYPLV | SEQ ID No 939 |
| TEYSEI | SEQ ID No 940 |
| TEYSEV | SEQ ID No 941 |
| TEYSTI | SEQ ID No 942 |
| TEYTKV | SEQ ID No 943 |
| TFYHVV | SEQ ID No 944 |
| TFYLLI | SEQ ID No 945 |
| TFYNKI | SEQ ID No 946 |
| TFYPDI | SEQ ID No 947 |
| TGYEDV | SEQ ID No 948 |
| TGYLSI | SEQ ID No 949 |
| THYKEI | SEQ ID No 950 |
| TIYAQV | SEQ ID No 951 |
| TIYAVV | SEQ ID No 952 |
| TIYCSI | SEQ ID No 953 |

| | |
|---|---|
| TIYEDV | SEQ ID No 954 |
| TIYERI | SEQ ID No 955 |
| TAYELV | SEQ ID No 86 |
| TIYEVI | SEQ ID No 956 |
| TIYHVI | SEQ ID No 957 |
| TIYIGV | SEQ ID No 958 |
| TIYLKV | SEQ ID No 959 |
| TIYSMI | SEQ ID No 960 |
| TIYSTI | SEQ ID No 961 |
| TIYTYI | SEQ ID No 962 |
| TKYFHI | SEQ ID No 963 |
| TKYMEI | SEQ ID No 964 |
| TKYQSV | SEQ ID No 965 |
| TKYSNI | SEQ ID No 966 |
| TKYSTV | SEQ ID No 967 |
| TLYASV | SEQ ID No 968 |
| TLYAVV | SEQ ID No 969 |
| TLYFWV | SEQ ID No 970 |
| TLYHLV | SEQ ID No 971 |
| TLYPMV | SEQ ID No 972 |
| TLYPPI | SEQ ID No 973 |
| TLYRDI | SEQ ID No 974 |
| TLYRDV | SEQ ID No 975 |
| TLYSKI | SEQ ID No 976 |
| TLYSLI | SEQ ID No 977 |
| TLYSPV | SEQ ID No 978 |
| TMYAQV | SEQ ID No 979 |
| TMYCQV | SEQ ID No 980 |
| TNYKAV | SEQ ID No 981 |
| TNYNLV | SEQ ID No 982 |
| TPYAGI | SEQ ID No 983 |
| TPYPGV | SEQ ID No 984 |
| TPYVDI | SEQ ID No 985 |
| TAYELV | SEQ ID No 86 |
| TQYGRV | SEQ ID No 986 |
| TQYNQV | SEQ ID No 987 |
| TRYAYV | SEQ ID No 988 |
| TRYGEV | SEQ ID No 989 |
| TRYHSV | SEQ ID No 990 |
| TRYKTI | SEQ ID No 991 |
| TRYLAI | SEQ ID No 992 |
| TRYMAI | SEQ ID No 993 |
| TRYQKI | SEQ ID No 994 |
| TRYQQI | SEQ ID No 995 |
| TRYSNI | SEQ ID No 996 |
| TRYSPI | SEQ ID No 997 |
| TSYGTV | SEQ ID No 998 |
| TSYMEV | SEQ ID No 999 |
| TSYQGV | SEQ ID No 1000 |
| TSYTTI | SEQ ID No 1001 |
| TTYRSI | SEQ ID No 1002 |
| TTYSDV | SEQ ID No 1003 |
| TTYVTI | SEQ ID No 1004 |
| TVYAQI | SEQ ID No 1005 |
| TVYASV | SEQ ID No 1006 |
| TVYEVI | SEQ ID No 1007 |
| TVYGDV | SEQ ID No 1008 |
| TVYKGI | SEQ ID No 1009 |
| TVYQRV | SEQ ID No 1010 |
| TVYSEV | SEQ ID No 1011 |
| TVYSTV | SEQ ID No 1012 |
| TYYHSI | SEQ ID No 1013 |
| TYYLQI | SEQ ID No 1014 |
| TYYYSV | SEQ ID No 1015 |
| TAYELV | SEQ ID No 86 |

In some embodiments, the ITSM, or at least one of the ITSMs when several ITSMs are present in the intracellular domain is TEYASI (SEQ ID NO: 936).

In some embodiments, the ITSM, or at least one of the ITSMs when several ITSMs are present in the intracellular domain is TEYSEI (SEQ ID NO: 940).

In some embodiments, the ITSM, or at least one of the ITSMs when several ITSMs are present in the intracellular domain is TVYSEV (SEQ ID NO: 1011).

In some embodiments, the ITSM, or at least one of the ITSMs when several ITSMs are present in the intracellular domain is TEYSTI (SEQ ID NO: 942).

In some embodiments, the ITIM, or at least one of the ITIMs when several ITIMs are present in the intracellular domain is selected from SEQ ID No 1016 to SEQ ID NO: 1100, SEQ ID NO: 2047, and SEQ ID NO: 1102 to SEQ ID 1998 (see below table).

| | |
|---|---|
| LLYEMV | SEQ ID No 1016 |
| ITYFAL | SEQ ID No 1017 |
| ISYKGL | SEQ ID No 1018 |
| LAYHTV | SEQ ID No 1019 |

| | |
|---|---|
| VQYLRL | SEQ ID No 1020 |
| LTYVLL | SEQ ID No 1021 |
| VRYSIV | SEQ ID No 1022 |
| LLYLLL | SEQ ID No 1023 |
| IAYGDI | SEQ ID No 1024 |
| IAYRDL | SEQ ID No 1025 |
| IAYSLL | SEQ ID No 1026 |
| IAYSRL | SEQ ID No 1027 |
| ICYALL | SEQ ID No 1028 |
| ICYDAL | SEQ ID No 1029 |
| ICYPLL | SEQ ID No 1030 |
| ICYQLI | SEQ ID No 1031 |
| IDYILV | SEQ ID No 1032 |
| IDYKTL | SEQ ID No 1033 |
| IDYTQL | SEQ ID No 1034 |
| IDYYNL | SEQ ID No 1035 |
| IEYCKL | SEQ ID No 1036 |
| IEYDQI | SEQ ID No 1037 |
| IEYGPL | SEQ ID No 1038 |
| IEYIRV | SEQ ID No 1039 |
| IEYKSL | SEQ ID No 1040 |
| IEYKTL | SEQ ID No 1041 |
| IEYSVL | SEQ ID No 1042 |
| IEYWGI | SEQ ID No 1043 |
| IFYGNV | SEQ ID No 1044 |
| IFYHNL | SEQ ID No 1045 |
| IFYKDI | SEQ ID No 1046 |
| IFYQNV | SEQ ID No 1047 |
| IFYRLI | SEQ ID No 1048 |
| IGYDIL | SEQ ID No 1049 |
| IGYDVL | SEQ ID No 1050 |
| IGYICL | SEQ ID No 1051 |
| IGYKAI | SEQ ID No 1052 |
| IGYLEL | SEQ ID No 1053 |
| IGYLPL | SEQ ID No 1054 |
| IGYLRL | SEQ ID No 1055 |
| IGYPFL | SEQ ID No 1056 |
| IGYSDL | SEQ ID No 1057 |
| IHYRQI | SEQ ID No 1058 |
| IHYSEL | SEQ ID No 1059 |
| IIYAFL | SEQ ID No 1060 |
| IIYHVI | SEQ ID No 1061 |
| IIYMFL | SEQ ID No 1062 |
| IIYNLL | SEQ ID No 1063 |
| IIYNNL | SEQ ID No 1064 |
| IIYSEV | SEQ ID No 1065 |
| IKYCLV | SEQ ID No 1066 |
| IKYKEL | SEQ ID No 1067 |
| IKYLAL | SEQ ID No 1068 |
| IKYTCI | SEQ ID No 1069 |
| ILYADI | SEQ ID No 1070 |
| ILYAFL | SEQ ID No 1071 |
| ILYCSV | SEQ ID No 1072 |
| ILYEGL | SEQ ID No 1073 |
| ILYELL | SEQ ID No 1074 |
| ILYFQI | SEQ ID No 1075 |
| ILYHTV | SEQ ID No 1076 |
| ILYLQV | SEQ ID No 1077 |
| ILYSIL | SEQ ID No 1078 |
| ILYSVL | SEQ ID No 1079 |
| ILYTEL | SEQ ID No 1080 |
| ILYTIL | SEQ ID No 1081 |
| IMYTLV | SEQ ID No 1082 |
| INYCSV | SEQ ID No 1083 |
| INYKDI | SEQ ID No 1084 |
| INYTTV | SEQ ID No 1085 |
| INYVLL | SEQ ID No 1086 |
| IPYDVL | SEQ ID No 1087 |
| IPYLLV | SEQ ID No 1088 |
| IPYRTV | SEQ ID No 1089 |
| IPYSQL | SEQ ID No 1090 |
| IPYSRI | SEQ ID No 1091 |
| IPYTQI | SEQ ID No 1092 |
| IQYAPL | SEQ ID No 1093 |
| IQYASL | SEQ ID No 1094 |
| IQYERL | SEQ ID No 1095 |
| IQYGII | SEQ ID No 1096 |
| IQYGNV | SEQ ID No 1097 |
| IQYGRV | SEQ ID No 1098 |
| IQYNVV | SEQ ID No 1099 |
| IQYRSI | SEQ ID No 1100 |

| | |
|---|---|
| IQYTEL | SEQ ID No 1101 |
| IQYWGI | SEQ ID No 1102 |
| IRYANL | SEQ ID No 1103 |
| IRYLDL | SEQ ID No 1104 |
| IRYPLL | SEQ ID No 1105 |
| IRYRLL | SEQ ID No 1106 |
| IRYRTI | SEQ ID No 1107 |
| ISYASL | SEQ ID No 1108 |
| ISYCGV | SEQ ID No 1109 |
| ISYEPI | SEQ ID No 1110 |
| ISYFQI | SEQ ID No 1111 |
| ISYGLI | SEQ ID No 1112 |
| ISYKKL | SEQ ID No 1113 |
| ISYLPL | SEQ ID No 1114 |
| ISYPML | SEQ ID No 1115 |
| ISYTTL | SEQ ID No 1116 |
| ITYAAV | SEQ ID No 1117 |
| ITYADL | SEQ ID No 1118 |
| ITYAEL | SEQ ID No 1119 |
| ITYAEV | SEQ ID No 1120 |
| ITYASV | SEQ ID No 1121 |
| ITYDLI | SEQ ID No 1122 |
| ITYENV | SEQ ID No 1123 |
| ITYQLL | SEQ ID No 1124 |
| ITYSLL | SEQ ID No 1125 |
| IVYAEL | SEQ ID No 1126 |
| IVYALV | SEQ ID No 1127 |
| IVYASL | SEQ ID No 1128 |
| IVYEIL | SEQ ID No 1129 |
| IVYFIL | SEQ ID No 1130 |
| IVYHML | SEQ ID No 1131 |
| IVYLCI | SEQ ID No 1132 |
| IVYRLL | SEQ ID No 1133 |
| IVYSAL | SEQ ID No 1134 |
| IVYSWV | SEQ ID No 1135 |
| IVYTEL | SEQ ID No 1136 |
| IVYYIL | SEQ ID No 1137 |
| IWYENL | SEQ ID No 1138 |
| IWYFVV | SEQ ID No 1139 |
| IWYNIL | SEQ ID No 1140 |
| IYYLGV | SEQ ID No 1141 |
| LAYALL | SEQ ID No 1142 |
| LAYARI | SEQ ID No 1143 |
| LAYDSV | SEQ ID No 1144 |
| LAYFGV | SEQ ID No 1145 |
| LAYHRL | SEQ ID No 1146 |
| LAYKDL | SEQ ID No 1147 |
| LAYKRI | SEQ ID No 1148 |
| LAYPPL | SEQ ID No 1149 |
| LAYQTL | SEQ ID No 1150 |
| LAYREV | SEQ ID No 1151 |
| LAYRII | SEQ ID No 1152 |
| LAYRLL | SEQ ID No 1153 |
| LAYSQL | SEQ ID No 1154 |
| LAYSSV | SEQ ID No 1155 |
| LAYTLL | SEQ ID No 1156 |
| LAYWGI | SEQ ID No 1157 |
| LAYYTV | SEQ ID No 1158 |
| LCYADL | SEQ ID No 1159 |
| LCYAIL | SEQ ID No 1160 |
| LCYFHL | SEQ ID No 1161 |
| LCYHPI | SEQ ID No 1162 |
| LCYKEI | SEQ ID No 1163 |
| LCYKFL | SEQ ID No 1164 |
| LCYMII | SEQ ID No 1165 |
| LCYRKI | SEQ ID No 1166 |
| LCYRVL | SEQ ID No 1167 |
| LCYSTV | SEQ ID No 1168 |
| LCYTLV | SEQ ID No 1169 |
| LDYASI | SEQ ID No 1170 |
| LDYCEL | SEQ ID No 1171 |
| LDYDKI | SEQ ID No 1172 |
| LDYDKL | SEQ ID No 1173 |
| LDYDYL | SEQ ID No 1174 |
| LDYDYV | SEQ ID No 1175 |
| LDYEFL | SEQ ID No 1176 |
| LDYINV | SEQ ID No 1177 |
| LDYNNL | SEQ ID No 1178 |
| LDYPHV | SEQ ID No 1179 |
| LDYSPV | SEQ ID No 1180 |
| LDYVEI | SEQ ID No 1181 |

| | |
|---|---|
| LDYWGI | SEQ ID No 1182 |
| LEYAPV | SEQ ID No 1183 |
| LEYIPL | SEQ ID No 1184 |
| LEYKTI | SEQ ID No 1185 |
| LEYLCL | SEQ ID No 1186 |
| LEYLKL | SEQ ID No 1187 |
| LEYLQI | SEQ ID No 1188 |
| LEYLQL | SEQ ID No 1189 |
| LEYQRL | SEQ ID No 1190 |
| LEYVDL | SEQ ID No 1191 |
| LEYVSV | SEQ ID No 1192 |
| LEYYQI | SEQ ID No 1193 |
| LFYAQL | SEQ ID No 1194 |
| LFYCSV | SEQ ID No 1195 |
| LFYERV | SEQ ID No 1196 |
| LFYGFL | SEQ ID No 1197 |
| LFYKYV | SEQ ID No 1198 |
| LFYLLL | SEQ ID No 1199 |
| LFYNKV | SEQ ID No 1200 |
| LFYRHL | SEQ ID No 1201 |
| LFYTLL | SEQ ID No 1202 |
| LFYWDV | SEQ ID No 1203 |
| LFYWKL | SEQ ID No 1204 |
| LGYGNV | SEQ ID No 1205 |
| LGYKEL | SEQ ID No 1206 |
| LGYLQL | SEQ ID No 1207 |
| LGYPLI | SEQ ID No 1208 |
| LGYPWV | SEQ ID No 1209 |
| LGYSAL | SEQ ID No 1210 |
| LGYSDL | SEQ ID No 1211 |
| LGYVTL | SEQ ID No 1212 |
| LHYAKI | SEQ ID No 1213 |
| LHYALV | SEQ ID No 1214 |
| LHYANL | SEQ ID No 1215 |
| LHYARL | SEQ ID No 1216 |
| LHYASI | SEQ ID No 1217 |
| LHYASL | SEQ ID No 1218 |
| LHYASV | SEQ ID No 1219 |
| LHYATI | SEQ ID No 1220 |
| LHYATL | SEQ ID No 1221 |
| LHYAVL | SEQ ID No 1222 |
| LHYDVV | SEQ ID No 1223 |
| LHYEGL | SEQ ID No 1224 |
| LHYETI | SEQ ID No 1225 |
| LHYFEI | SEQ ID No 1226 |
| LHYFVV | SEQ ID No 1227 |
| LHYGAI | SEQ ID No 1228 |
| LHYILI | SEQ ID No 1229 |
| LHYINL | SEQ ID No 1230 |
| LHYKRI | SEQ ID No 1231 |
| LHYLDL | SEQ ID No 1232 |
| LHYLNI | SEQ ID No 1233 |
| LHYLTI | SEQ ID No 1234 |
| LHYLVI | SEQ ID No 1235 |
| LHYMAI | SEQ ID No 1236 |
| LHYMII | SEQ ID No 1237 |
| LHYMNI | SEQ ID No 1238 |
| LHYMTI | SEQ ID No 1239 |
| LHYMTL | SEQ ID No 1240 |
| LHYMTV | SEQ ID No 1241 |
| LHYMVI | SEQ ID No 1242 |
| LHYNML | SEQ ID No 1243 |
| LHYPAL | SEQ ID No 1244 |
| LHYPDL | SEQ ID No 1245 |
| LHYPII | SEQ ID No 1246 |
| LHYPIL | SEQ ID No 1247 |
| LHYPLL | SEQ ID No 1248 |
| LHYPML | SEQ ID No 1249 |
| LHYPNV | SEQ ID No 1250 |
| LHYPSI | SEQ ID No 1251 |
| LHYPTI | SEQ ID No 1252 |
| LHYPTL | SEQ ID No 1253 |
| LHYPTV | SEQ ID No 1254 |
| LHYPVI | SEQ ID No 1255 |
| LHYPVL | SEQ ID No 1256 |
| LHYRII | SEQ ID No 1257 |
| LHYRTI | SEQ ID No 1258 |
| LHYSII | SEQ ID No 1259 |
| LHYSSI | SEQ ID No 1260 |
| LHYSTI | SEQ ID No 1261 |
| LHYSTL | SEQ ID No 1262 |

| | | | | |
|---|---|---|---|---|
| LHYSVI | SEQ ID No 1263 | | LLYADL | SEQ ID No 1303 |
| LHYTAI | SEQ ID No 1264 | | LLYAPL | SEQ ID No 1304 |
| LHYTAL | SEQ ID No 1265 | | LLYAVV | SEQ ID No 1305 |
| LHYTII | SEQ ID No 1266 | | LLYCAI | SEQ ID No 1306 |
| LHYTKV | SEQ ID No 1267 | | LLYEHV | SEQ ID No 1307 |
| LHYTLI | SEQ ID No 1268 | | LLYELL | SEQ ID No 1308 |
| LHYTSI | SEQ ID No 1269 | | LLYEQL | SEQ ID No 1309 |
| LHYTTI | SEQ ID No 1270 | | LLYGQI | SEQ ID No 1310 |
| LHYTTV | SEQ ID No 1271 | | LLYIRL | SEQ ID No 1311 |
| LHYTVI | SEQ ID No 1272 | | LLYKAL | SEQ ID No 1312 |
| LHYTVL | SEQ ID No 1273 | | LLYKFL | SEQ ID No 1313 |
| LHYTVV | SEQ ID No 1274 | | LLYKLL | SEQ ID No 1314 |
| LHYVSI | SEQ ID No 1275 | | LLYKTV | SEQ ID No 1315 |
| LHYVTI | SEQ ID No 1276 | | LLYMVV | SEQ ID No 1316 |
| LHYVVI | SEQ ID No 1277 | | LLYNAI | SEQ ID No 1317 |
| LIYEKL | SEQ ID No 1278 | | LLYNIV | SEQ ID No 1318 |
| LIYENV | SEQ ID No 1279 | | LLYNVI | SEQ ID No 1319 |
| LIYKDL | SEQ ID No 1280 | | LLYPAI | SEQ ID No 1320 |
| LIYNSL | SEQ ID No 1281 | | LLYPLI | SEQ ID No 1321 |
| LIYSGL | SEQ ID No 1282 | | LLYPNI | SEQ ID No 1322 |
| LIYTLL | SEQ ID No 1283 | | LLYPSL | SEQ ID No 1323 |
| LIYTVL | SEQ ID No 1284 | | LLYPTI | SEQ ID No 1324 |
| LIYWEI | SEQ ID No 1285 | | LLYPVI | SEQ ID No 1325 |
| LKYCEL | SEQ ID No 1286 | | LLYPVV | SEQ ID No 1326 |
| LKYDKL | SEQ ID No 1287 | | LLYQIL | SEQ ID No 1327 |
| LKYESL | SEQ ID No 1288 | | LLYQNI | SEQ ID No 1328 |
| LKYFTI | SEQ ID No 1289 | | LLYRLL | SEQ ID No 1329 |
| LKYHTV | SEQ ID No 1290 | | LLYRVI | SEQ ID No 1330 |
| LKYILL | SEQ ID No 1291 | | LLYSII | SEQ ID No 1331 |
| LKYIPI | SEQ ID No 1292 | | LLYSLI | SEQ ID No 1332 |
| LKYKHV | SEQ ID No 1293 | | LLYSPV | SEQ ID No 1333 |
| LKYLYL | SEQ ID No 1294 | | LLYSRL | SEQ ID No 1334 |
| LKYMEV | SEQ ID No 1295 | | LLYSTI | SEQ ID No 1335 |
| LKYMTL | SEQ ID No 1296 | | LLYSVI | SEQ ID No 1336 |
| LKYPAI | SEQ ID No 1297 | | LLYSVV | SEQ ID No 1337 |
| LKYPDV | SEQ ID No 1298 | | LLYTTI | SEQ ID No 1338 |
| LKYPEL | SEQ ID No 1299 | | LLYTVI | SEQ ID No 1339 |
| LKYQPI | SEQ ID No 1300 | | LLYTVV | SEQ ID No 1340 |
| LKYRGL | SEQ ID No 1301 | | LLYVII | SEQ ID No 1341 |
| LKYRLL | SEQ ID No 1302 | | LLYVIL | SEQ ID No 1342 |
| | | | LLYVTI | SEQ ID No 1343 |

| | |
|---|---|
| LLYWGI | SEQ ID No 1344 |
| LLYYLL | SEQ ID No 1345 |
| LLYYVI | SEQ ID No 1346 |
| LMYDNV | SEQ ID No 1347 |
| LMYMVV | SEQ ID No 1348 |
| LMYQEL | SEQ ID No 1349 |
| LMYRGI | SEQ ID No 1350 |
| LNYACL | SEQ ID No 1351 |
| LNYATI | SEQ ID No 1352 |
| LNYEVI | SEQ ID No 1353 |
| LNYGDL | SEQ ID No 1354 |
| LNYHKL | SEQ ID No 1355 |
| LNYMVL | SEQ ID No 1356 |
| LNYNIV | SEQ ID No 1357 |
| LNYPVI | SEQ ID No 1358 |
| LNYQMI | SEQ ID No 1359 |
| LNYSGV | SEQ ID No 1360 |
| LNYSVI | SEQ ID No 1361 |
| LNYTIL | SEQ ID No 1362 |
| LNYTTI | SEQ ID No 1363 |
| LNYVPI | SEQ ID No 1364 |
| LPYADL | SEQ ID No 1365 |
| LPYALL | SEQ ID No 1366 |
| LPYFNI | SEQ ID No 1367 |
| LPYFNV | SEQ ID No 1368 |
| LPYHDL | SEQ ID No 1369 |
| LPYKLI | SEQ ID No 1370 |
| LPYKTL | SEQ ID No 1371 |
| LPYLGV | SEQ ID No 1372 |
| LPYLKV | SEQ ID No 1373 |
| LPYPAL | SEQ ID No 1374 |
| LPYQVV | SEQ ID No 1375 |
| LPYRTV | SEQ ID No 1376 |
| LPYVEI | SEQ ID No 1377 |
| LPYYDL | SEQ ID No 1378 |
| LQYASL | SEQ ID No 1379 |
| LQYERI | SEQ ID No 1380 |
| LQYFAV | SEQ ID No 1381 |
| LQYFSI | SEQ ID No 1382 |
| LQYHNI | SEQ ID No 1383 |
| LQYIGL | SEQ ID No 1384 |
| LQYIKI | SEQ ID No 1385 |
| LQYLSL | SEQ ID No 1386 |
| LQYMIV | SEQ ID No 1387 |
| LQYPAI | SEQ ID No 1388 |
| LQYPLL | SEQ ID No 1389 |
| LQYPLV | SEQ ID No 1390 |
| LQYPSI | SEQ ID No 1391 |
| LQYPTL | SEQ ID No 1392 |
| LQYPVL | SEQ ID No 1393 |
| LQYRAV | SEQ ID No 1394 |
| LQYSAI | SEQ ID No 1395 |
| LQYSSI | SEQ ID No 1396 |
| LQYSVI | SEQ ID No 1397 |
| LQYTIL | SEQ ID No 1398 |
| LQYTLI | SEQ ID No 1399 |
| LQYTMI | SEQ ID No 1400 |
| LQYYQV | SEQ ID No 1401 |
| LRYAAV | SEQ ID No 1402 |
| LRYAGL | SEQ ID No 1403 |
| LRYAPL | SEQ ID No 1404 |
| LRYASI | SEQ ID No 1405 |
| LRYATI | SEQ ID No 1406 |
| LRYATV | SEQ ID No 1407 |
| LRYAVL | SEQ ID No 1408 |
| LRYCGI | SEQ ID No 1409 |
| LRYELL | SEQ ID No 1410 |
| LRYETL | SEQ ID No 1411 |
| LRYGAL | SEQ ID No 1412 |
| LRYGPI | SEQ ID No 1413 |
| LRYGTL | SEQ ID No 1414 |
| LRYHHI | SEQ ID No 1415 |
| LRYHSI | SEQ ID No 1416 |
| LRYHVL | SEQ ID No 1417 |
| LRYIAI | SEQ ID No 1418 |
| LRYIFV | SEQ ID No 1419 |
| LRYITV | SEQ ID No 1420 |
| LRYKEV | SEQ ID No 1421 |
| LRYKKL | SEQ ID No 1422 |
| LRYKMV | SEQ ID No 1423 |
| LRYKSL | SEQ ID No 1424 |

| | |
|---|---|
| LRYKVI | SEQ ID No 1425 |
| LRYLAI | SEQ ID No 1426 |
| LRYLDL | SEQ ID No 1427 |
| LRYLTI | SEQ ID No 1428 |
| LRYLTV | SEQ ID No 1429 |
| LRYMSI | SEQ ID No 1430 |
| LRYMVI | SEQ ID No 1431 |
| LRYNCI | SEQ ID No 1432 |
| LRYNGL | SEQ ID No 1433 |
| LRYNII | SEQ ID No 1434 |
| LRYNIL | SEQ ID No 1435 |
| LRYNKI | SEQ ID No 1436 |
| LRYNSL | SEQ ID No 1437 |
| LRYNVI | SEQ ID No 1438 |
| LRYNVL | SEQ ID No 1439 |
| LRYPFL | SEQ ID No 1440 |
| LRYPII | SEQ ID No 1441 |
| LRYPIL | SEQ ID No 1442 |
| LRYPLL | SEQ ID No 1443 |
| LRYPNI | SEQ ID No 1444 |
| LRYPSI | SEQ ID No 1445 |
| LRYPTI | SEQ ID No 1446 |
| LRYPTL | SEQ ID No 1447 |
| LRYPVI | SEQ ID No 1448 |
| LRYPVL | SEQ ID No 1449 |
| LRYQKL | SEQ ID No 1450 |
| LRYQMI | SEQ ID No 1451 |
| LRYQNL | SEQ ID No 1452 |
| LRYRLI | SEQ ID No 1453 |
| LRYRVI | SEQ ID No 1454 |
| LRYSAI | SEQ ID No 1455 |
| LRYSDL | SEQ ID No 1456 |
| LRYSII | SEQ ID No 1457 |
| LRYSMI | SEQ ID No 1458 |
| LRYSSI | SEQ ID No 1459 |
| LRYSTI | SEQ ID No 1460 |
| LRYSTL | SEQ ID No 1461 |
| LRYSVI | SEQ ID No 1462 |
| LRYSVL | SEQ ID No 1463 |
| LRYSVV | SEQ ID No 1464 |
| LRYTAI | SEQ ID No 1465 |
| LRYTIL | SEQ ID No 1466 |
| LRYTLI | SEQ ID No 1467 |
| LRYTMI | SEQ ID No 1468 |
| LRYTNL | SEQ ID No 1469 |
| LRYTPV | SEQ ID No 1470 |
| LRYTSI | SEQ ID No 1471 |
| LRYTSV | SEQ ID No 1472 |
| LRYTTI | SEQ ID No 1473 |
| LRYTTV | SEQ ID No 1474 |
| LRYTVI | SEQ ID No 1475 |
| LRYVEV | SEQ ID No 1476 |
| LRYVTI | SEQ ID No 1477 |
| LRYVTV | SEQ ID No 1478 |
| LSYDSL | SEQ ID No 1479 |
| LSYEDV | SEQ ID No 1480 |
| LSYFGV | SEQ ID No 1481 |
| LSYILI | SEQ ID No 1482 |
| LSYISV | SEQ ID No 1483 |
| LSYKQV | SEQ ID No 1484 |
| LSYKRL | SEQ ID No 1485 |
| LSYLDV | SEQ ID No 1486 |
| LSYMDL | SEQ ID No 1487 |
| LSYNAL | SEQ ID No 1488 |
| LSYNDL | SEQ ID No 1489 |
| LSYNKL | SEQ ID No 1490 |
| LSYNQL | SEQ ID No 1491 |
| LSYPVL | SEQ ID No 1492 |
| LSYQEV | SEQ ID No 1493 |
| LSYQPV | SEQ ID No 1494 |
| LSYQTI | SEQ ID No 1495 |
| LSYRSL | SEQ ID No 1496 |
| LSYRSV | SEQ ID No 1497 |
| LSYSII | SEQ ID No 1498 |
| LSYSSL | SEQ ID No 1499 |
| LSYSTL | SEQ ID No 1500 |
| LSYTKV | SEQ ID No 1501 |
| LSYTSI | SEQ ID No 1502 |
| LSYTTI | SEQ ID No 1503 |
| LSYVLI | SEQ ID No 1504 |
| LTYADL | SEQ ID No 1505 |

| | |
|---|---|
| LTYAEL | SEQ ID No 1506 |
| LTYAQV | SEQ ID No 1507 |
| LTYARL | SEQ ID No 1508 |
| LTYCDL | SEQ ID No 1509 |
| LTYCGL | SEQ ID No 1510 |
| LTYCVL | SEQ ID No 1511 |
| LTYEEL | SEQ ID No 1512 |
| LTYEFL | SEQ ID No 1513 |
| LTYGEV | SEQ ID No 1514 |
| LTYGRL | SEQ ID No 1515 |
| LTYKAL | SEQ ID No 1516 |
| LTYLRL | SEQ ID No 1517 |
| LTYMTL | SEQ ID No 1518 |
| LTYNTL | SEQ ID No 1519 |
| LTYPGI | SEQ ID No 1520 |
| LTYQSV | SEQ ID No 1521 |
| LTYSSV | SEQ ID No 1522 |
| LTYTTV | SEQ ID No 1523 |
| LVYDAI | SEQ ID No 1524 |
| LVYDKL | SEQ ID No 1525 |
| LVYDLV | SEQ ID No 1526 |
| LVYENL | SEQ ID No 1527 |
| LVYGQL | SEQ ID No 1528 |
| LVYHKL | SEQ ID No 1529 |
| LVYQEV | SEQ ID No 1530 |
| LVYRKV | SEQ ID No 1531 |
| LVYRNL | SEQ ID No 1532 |
| LVYSEI | SEQ ID No 1533 |
| LVYTNV | SEQ ID No 1534 |
| LVYWEI | SEQ ID No 1535 |
| LVYWKL | SEQ ID No 1536 |
| LVYWRL | SEQ ID No 1537 |
| LWYEGL | SEQ ID No 1538 |
| LWYKYI | SEQ ID No 1539 |
| LWYNHI | SEQ ID No 1540 |
| LWYTMI | SEQ ID No 1541 |
| LYYCQL | SEQ ID No 1542 |
| LYYGDL | SEQ ID No 1543 |
| LYYKKV | SEQ ID No 1544 |
| LYYLLI | SEQ ID No 1545 |
| LYYPKV | SEQ ID No 1546 |
| LYYRRV | SEQ ID No 1547 |
| LYYSTI | SEQ ID No 1548 |
| LYYVRI | SEQ ID No 1549 |
| LYYVVI | SEQ ID No 1550 |
| SAYATL | SEQ ID No 1551 |
| SAYCPL | SEQ ID No 1552 |
| SAYPAL | SEQ ID No 1553 |
| SAYQAL | SEQ ID No 1554 |
| SAYQTI | SEQ ID No 1555 |
| SAYRSV | SEQ ID No 1556 |
| SAYTAL | SEQ ID No 1557 |
| SAYTPL | SEQ ID No 1558 |
| SAYVVL | SEQ ID No 1559 |
| SCYAAV | SEQ ID No 1560 |
| SCYCII | SEQ ID No 1561 |
| SCYCLL | SEQ ID No 1562 |
| SCYDFL | SEQ ID No 1563 |
| SCYEEL | SEQ ID No 1564 |
| SCYEKI | SEQ ID No 1565 |
| SCYHIL | SEQ ID No 1566 |
| SCYPYI | SEQ ID No 1567 |
| SCYRIL | SEQ ID No 1568 |
| SCYRTL | SEQ ID No 1569 |
| SDYCNL | SEQ ID No 1570 |
| SDYEDL | SEQ ID No 1571 |
| SDYENV | SEQ ID No 1572 |
| SDYESV | SEQ ID No 1573 |
| SDYFIV | SEQ ID No 1574 |
| SDYHTL | SEQ ID No 1575 |
| SDYLAI | SEQ ID No 1576 |
| SDYLDI | SEQ ID No 1577 |
| SDYLEL | SEQ ID No 1578 |
| SDYQDL | SEQ ID No 1579 |
| SDYQRL | SEQ ID No 1580 |
| SDYSVI | SEQ ID No 1581 |
| SDYTHL | SEQ ID No 1582 |
| SEYASV | SEQ ID No 1583 |
| SEYEEL | SEQ ID No 1584 |
| SEYFEL | SEQ ID No 1585 |
| SEYGEL | SEQ ID No 1586 |

-continued

| | |
|---|---|
| SEYITL | SEQ ID No 1587 |
| SEYKAL | SEQ ID No 1588 |
| SEYKEL | SEQ ID No 1589 |
| SEYKGI | SEQ ID No 1590 |
| SEYLAI | SEQ ID No 1591 |
| SEYLEI | SEQ ID No 1592 |
| SEYMVI | SEQ ID No 1593 |
| SEYQSI | SEQ ID No 1594 |
| SEYRPI | SEQ ID No 1595 |
| SEYSEI | SEQ ID No 1596 |
| SEYSSI | SEQ ID No 1597 |
| SEYTPI | SEQ ID No 1598 |
| SEYTYV | SEQ ID No 1599 |
| SFYAAL | SEQ ID No 1600 |
| SFYDSL | SEQ ID No 1601 |
| SFYKGL | SEQ ID No 1602 |
| SFYLYV | SEQ ID No 1603 |
| SFYNAV | SEQ ID No 1604 |
| SFYPSV | SEQ ID No 1605 |
| SFYQQI | SEQ ID No 1606 |
| SFYQQL | SEQ ID No 1607 |
| SFYSAL | SEQ ID No 1608 |
| SFYSDI | SEQ ID No 1609 |
| SFYSKL | SEQ ID No 1610 |
| SFYSRV | SEQ ID No 1611 |
| SFYWNV | SEQ ID No 1612 |
| SFYYLI | SEQ ID No 1613 |
| SGYAQL | SEQ ID No 1614 |
| SGYATL | SEQ ID No 1615 |
| SGYEKL | SEQ ID No 1616 |
| SGYQLV | SEQ ID No 1617 |
| SGYQRI | SEQ ID No 1618 |
| SGYRRL | SEQ ID No 1619 |
| SGYSHL | SEQ ID No 1620 |
| SGYSQL | SEQ ID No 1621 |
| SGYTLI | SEQ ID No 1622 |
| SGYTRI | SEQ ID No 1623 |
| SGYYRV | SEQ ID No 1624 |
| SHYADV | SEQ ID No 1625 |
| SHYFPL | SEQ ID No 1626 |

-continued

| | |
|---|---|
| SHYIDI | SEQ ID No 1627 |
| SHYKRL | SEQ ID No 1628 |
| SHYQVV | SEQ ID No 1629 |
| SIYAPL | SEQ ID No 1630 |
| SIYATL | SEQ ID No 1631 |
| SIYEEL | SEQ ID No 1632 |
| SIYEEV | SEQ ID No 1633 |
| SIYELL | SEQ ID No 1634 |
| SIYEVL | SEQ ID No 1635 |
| SIYGDL | SEQ ID No 1636 |
| SIYKKL | SEQ ID No 1637 |
| SIYLNI | SEQ ID No 1638 |
| SIYLVI | SEQ ID No 1639 |
| SIYRYI | SEQ ID No 1640 |
| SIYSWI | SEQ ID No 1641 |
| SKYKEI | SEQ ID No 1642 |
| SKYKIL | SEQ ID No 1643 |
| SKYKSL | SEQ ID No 1644 |
| SKYLAV | SEQ ID No 1645 |
| SKYLGV | SEQ ID No 1646 |
| SKYNIL | SEQ ID No 1647 |
| SKYQAV | SEQ ID No 1648 |
| SKYSDI | SEQ ID No 1649 |
| SKYSSL | SEQ ID No 1650 |
| SKYVGL | SEQ ID No 1651 |
| SKYVSL | SEQ ID No 1652 |
| SLYANI | SEQ ID No 1653 |
| SLYAQV | SEQ ID No 1654 |
| SLYAYI | SEQ ID No 1655 |
| SLYDDL | SEQ ID No 1656 |
| SLYDFL | SEQ ID No 1657 |
| SLYDNL | SEQ ID No 1658 |
| SLYDSI | SEQ ID No 1659 |
| SLYDYL | SEQ ID No 1660 |
| SLYEGL | SEQ ID No 1661 |
| SLYEHI | SEQ ID No 1662 |
| SLYELL | SEQ ID No 1663 |
| SLYHCL | SEQ ID No 1664 |
| SLYHKL | SEQ ID No 1665 |
| SLYIGI | SEQ ID No 1666 |
| SLYKKL | SEQ ID No 1667 |

| | |
|---|---|
| SLYKNL | SEQ ID No 1668 |
| SLYLAI | SEQ ID No 1669 |
| SLYLGI | SEQ ID No 1670 |
| SLYNAL | SEQ ID No 1671 |
| SLYNLL | SEQ ID No 1672 |
| SLYRNI | SEQ ID No 1673 |
| SLYSDV | SEQ ID No 1674 |
| SLYTCV | SEQ ID No 1675 |
| SLYTTL | SEQ ID No 1676 |
| SLYVAI | SEQ ID No 1677 |
| SLYVDV | SEQ ID No 1678 |
| SLYVSI | SEQ ID No 1679 |
| SLYYAL | SEQ ID No 1680 |
| SLYYNI | SEQ ID No 1681 |
| SLYYPI | SEQ ID No 1682 |
| SMYDGL | SEQ ID No 1683 |
| SMYEDI | SEQ ID No 1684 |
| SMYNEI | SEQ ID No 1685 |
| SMYQSV | SEQ ID No 1686 |
| SMYTWL | SEQ ID No 1687 |
| SMYVSI | SEQ ID No 1688 |
| SNYENL | SEQ ID No 1689 |
| SNYGSL | SEQ ID No 1690 |
| SNYGTI | SEQ ID No 1691 |
| SNYLVL | SEQ ID No 1692 |
| SNYQEI | SEQ ID No 1693 |
| SNYRLL | SEQ ID No 1694 |
| SNYRTL | SEQ ID No 1695 |
| SNYSDI | SEQ ID No 1696 |
| SNYSLL | SEQ ID No 1697 |
| SPYAEI | SEQ ID No 1698 |
| SPYATL | SEQ ID No 1699 |
| SPYEKV | SEQ ID No 1700 |
| SPYGDI | SEQ ID No 1701 |
| SPYGGL | SEQ ID No 1702 |
| SPYNTL | SEQ ID No 1703 |
| SPYPGI | SEQ ID No 1704 |
| SPYPGV | SEQ ID No 1705 |
| SPYQEL | SEQ ID No 1706 |
| SPYRSV | SEQ ID No 1707 |
| SPYSRL | SEQ ID No 1708 |
| SPYTDV | SEQ ID No 1709 |
| SPYTSV | SEQ ID No 1710 |
| SPYVVI | SEQ ID No 1711 |
| SQYCVL | SEQ ID No 1712 |
| SQYEAL | SEQ ID No 1713 |
| SQYKRL | SEQ ID No 1714 |
| SQYLAL | SEQ ID No 1715 |
| SQYLRL | SEQ ID No 1716 |
| SQYMHV | SEQ ID No 1717 |
| SQYSAV | SEQ ID No 1718 |
| SQYTSI | SEQ ID No 1719 |
| SQYWRL | SEQ ID No 1720 |
| SRYAEL | SEQ ID No 1721 |
| SRYATL | SEQ ID No 1722 |
| SRYESL | SEQ ID No 1723 |
| SRYGLL | SEQ ID No 1724 |
| SRYLSL | SEQ ID No 1725 |
| SRYMEL | SEQ ID No 1726 |
| SRYMRI | SEQ ID No 1727 |
| SRYPPV | SEQ ID No 1728 |
| SRYQAL | SEQ ID No 1729 |
| SRYQQL | SEQ ID No 1730 |
| SRYRFI | SEQ ID No 1731 |
| SRYRFV | SEQ ID No 1732 |
| SRYSAL | SEQ ID No 1733 |
| SRYSDL | SEQ ID No 1734 |
| SRYTGL | SEQ ID No 1735 |
| SRYVRL | SEQ ID No 1736 |
| SSYDEL | SEQ ID No 1737 |
| SSYEAL | SEQ ID No 1738 |
| SSYEIV | SEQ ID No 1739 |
| SSYEPL | SEQ ID No 1740 |
| SSYGRL | SEQ ID No 1741 |
| SSYGSI | SEQ ID No 1742 |
| SSYGSL | SEQ ID No 1743 |
| SSYHII | SEQ ID No 1744 |
| SSYHIL | SEQ ID No 1745 |
| SSYHKL | SEQ ID No 1746 |
| SSYHNI | SEQ ID No 1747 |
| SSYIKV | SEQ ID No 1748 |

| | |
|---|---|
| SSYNSV | SEQ ID No 1749 |
| SSYQEI | SEQ ID No 1750 |
| SSYRKV | SEQ ID No 1751 |
| SSYRRV | SEQ ID No 1752 |
| SSYSDI | SEQ ID No 1753 |
| SSYTPL | SEQ ID No 1754 |
| SSYTRL | SEQ ID No 1755 |
| SSYTSV | SEQ ID No 1756 |
| SSYTTI | SEQ ID No 1757 |
| SSYVKL | SEQ ID No 1758 |
| STYAEV | SEQ ID No 1759 |
| STYAGI | SEQ ID No 1760 |
| STYAHL | SEQ ID No 1761 |
| STYALV | SEQ ID No 1762 |
| STYAPI | SEQ ID No 1763 |
| STYDHV | SEQ ID No 1764 |
| STYDKV | SEQ ID No 1765 |
| STYDQV | SEQ ID No 1766 |
| STYDRI | SEQ ID No 1767 |
| STYEEL | SEQ ID No 1768 |
| STYEYL | SEQ ID No 1769 |
| STYILV | SEQ ID No 1770 |
| STYLPL | SEQ ID No 1771 |
| STYMAV | SEQ ID No 1772 |
| STYQTL | SEQ ID No 1773 |
| STYRKL | SEQ ID No 1774 |
| STYSQL | SEQ ID No 1775 |
| STYTSI | SEQ ID No 1776 |
| STYYQV | SEQ ID No 1777 |
| SVYATL | SEQ ID No 1778 |
| SVYCFL | SEQ ID No 1779 |
| SVYCNL | SEQ ID No 1780 |
| SVYDSV | SEQ ID No 1781 |
| SVYDTI | SEQ ID No 1782 |
| SVYEKV | SEQ ID No 1783 |
| SVYEML | SEQ ID No 1784 |
| SVYGSV | SEQ ID No 1785 |
| SVYPII | SEQ ID No 1786 |
| SVYQPI | SEQ ID No 1787 |
| SVYRKV | SEQ ID No 1788 |
| SVYSHL | SEQ ID No 1789 |
| SVYSRV | SEQ ID No 1790 |
| SVYTAL | SEQ ID No 1791 |
| SVYTEL | SEQ ID No 1792 |
| SVYWKV | SEQ ID No 1793 |
| SWYDSI | SEQ ID No 1794 |
| SWYFTV | SEQ ID No 1795 |
| SYYKAI | SEQ ID No 1796 |
| SYYLKL | SEQ ID No 1797 |
| SYYSFV | SEQ ID No 1798 |
| SYYVTI | SEQ ID No 1799 |
| VAYADL | SEQ ID No 1800 |
| VAYARI | SEQ ID No 1801 |
| VAYARV | SEQ ID No 1802 |
| VAYDQL | SEQ ID No 1803 |
| VAYGHV | SEQ ID No 1804 |
| VAYKQV | SEQ ID No 1805 |
| VAYKRL | SEQ ID No 1806 |
| VAYNLL | SEQ ID No 1807 |
| VAYQRV | SEQ ID No 1808 |
| VAYSGV | SEQ ID No 1809 |
| VAYSQV | SEQ ID No 1810 |
| VCYCIV | SEQ ID No 1811 |
| VCYGLV | SEQ ID No 1812 |
| VCYGRL | SEQ ID No 1813 |
| VCYIVV | SEQ ID No 1814 |
| VCYLLV | SEQ ID No 1815 |
| VDYDCI | SEQ ID No 1816 |
| VDYDFL | SEQ ID No 1817 |
| VDYFTI | SEQ ID No 1818 |
| VDYFVL | SEQ ID No 1819 |
| VDYGEL | SEQ ID No 1820 |
| VDYILV | SEQ ID No 1821 |
| VDYIQV | SEQ ID No 1822 |
| VDYKNI | SEQ ID No 1823 |
| VDYMSI | SEQ ID No 1824 |
| VDYNLV | SEQ ID No 1825 |
| VDYPDV | SEQ ID No 1826 |
| VDYSDL | SEQ ID No 1827 |
| VDYSSV | SEQ ID No 1828 |
| VDYTTL | SEQ ID No 1829 |

-continued

| | |
|---|---|
| VDYVDV | SEQ ID No 1830 |
| VDYVGV | SEQ ID No 1831 |
| VDYVIL | SEQ ID No 1832 |
| VDYVQV | SEQ ID No 1833 |
| VEYAPL | SEQ ID No 1834 |
| VEYDPL | SEQ ID No 1835 |
| VEYGTI | SEQ ID No 1836 |
| VEYHRL | SEQ ID No 1837 |
| VEYLEV | SEQ ID No 1838 |
| VEYQLL | SEQ ID No 1839 |
| VEYRPL | SEQ ID No 1840 |
| VEYSSI | SEQ ID No 1841 |
| VEYSTV | SEQ ID No 1842 |
| VFYAEI | SEQ ID No 1843 |
| VFYLAV | SEQ ID No 1844 |
| VFYRQV | SEQ ID No 1845 |
| VFYVGV | SEQ ID No 1846 |
| VFYYVI | SEQ ID No 1847 |
| VFYYVL | SEQ ID No 1848 |
| VGYETI | SEQ ID No 1849 |
| VHYALL | SEQ ID No 1850 |
| VHYARL | SEQ ID No 1851 |
| VHYETL | SEQ ID No 1852 |
| VHYGGV | SEQ ID No 1853 |
| VHYHSL | SEQ ID No 1854 |
| VHYIPV | SEQ ID No 1855 |
| VHYKEI | SEQ ID No 1856 |
| VHYLQV | SEQ ID No 1857 |
| VHYNSL | SEQ ID No 1858 |
| VHYQSV | SEQ ID No 1859 |
| VHYRSL | SEQ ID No 1860 |
| VIYAQL | SEQ ID No 1861 |
| VIYDRL | SEQ ID No 1862 |
| VIYENV | SEQ ID No 1863 |
| VIYEPL | SEQ ID No 1864 |
| VIYERL | SEQ ID No 1865 |
| VIYIDV | SEQ ID No 1866 |
| VIYKKI | SEQ ID No 1867 |
| VIYKRI | SEQ ID No 1868 |
| VIYPFL | SEQ ID No 1869 |

-continued

| | |
|---|---|
| VIYPNI | SEQ ID No 1870 |
| VIYSDL | SEQ ID No 1871 |
| VIYSML | SEQ ID No 1872 |
| VIYSSV | SEQ ID No 1873 |
| VIYSWI | SEQ ID No 1874 |
| VKYADI | SEQ ID No 1875 |
| VKYARL | SEQ ID No 1876 |
| VKYATL | SEQ ID No 1877 |
| VKYEGL | SEQ ID No 1878 |
| VKYGDL | SEQ ID No 1879 |
| VKYGSV | SEQ ID No 1880 |
| VKYLLV | SEQ ID No 1881 |
| VKYNPV | SEQ ID No 1882 |
| VKYPPI | SEQ ID No 1883 |
| VKYQRL | SEQ ID No 1884 |
| VKYQVI | SEQ ID No 1885 |
| VKYSEV | SEQ ID No 1886 |
| VKYSNV | SEQ ID No 1887 |
| VKYSRL | SEQ ID No 1888 |
| VKYSTL | SEQ ID No 1889 |
| VKYVDL | SEQ ID No 1890 |
| VLYADI | SEQ ID No 1891 |
| VLYAML | SEQ ID No 1892 |
| VLYASV | SEQ ID No 1893 |
| VLYCLL | SEQ ID No 1894 |
| VLYCLV | SEQ ID No 1895 |
| VLYCVL | SEQ ID No 1896 |
| VLYDCL | SEQ ID No 1897 |
| VLYFHI | SEQ ID No 1898 |
| VLYFTV | SEQ ID No 1899 |
| VLYGDL | SEQ ID No 1900 |
| VLYGQL | SEQ ID No 1901 |
| VLYPMV | SEQ ID No 1902 |
| VLYPRL | SEQ ID No 1903 |
| VLYPRV | SEQ ID No 1904 |
| VLYSEL | SEQ ID No 1905 |
| VLYSRV | SEQ ID No 1906 |
| VLYTAV | SEQ ID No 1907 |
| VLYTIL | SEQ ID No 1908 |
| VMYDAV | SEQ ID No 1909 |
| VNYESI | SEQ ID No 1910 |

-continued

| | |
|---|---|
| VNYSAL | SEQ ID No 1911 |
| VNYSKI | SEQ ID No 1912 |
| VNYSSI | SEQ ID No 1913 |
| VPYALL | SEQ ID No 1914 |
| VPYDTL | SEQ ID No 1915 |
| VPYEDV | SEQ ID No 1916 |
| VPYEEL | SEQ ID No 1917 |
| VPYKTI | SEQ ID No 1918 |
| VPYLRV | SEQ ID No 1919 |
| VPYNDL | SEQ ID No 1920 |
| VPYPAL | SEQ ID No 1921 |
| VPYQEL | SEQ ID No 1922 |
| VPYRLL | SEQ ID No 1923 |
| VPYSEL | SEQ ID No 1924 |
| VPYTLL | SEQ ID No 1925 |
| VPYTPL | SEQ ID No 1926 |
| VPYTTL | SEQ ID No 1927 |
| VPYVEL | SEQ ID No 1928 |
| VPYVMV | SEQ ID No 1929 |
| VPYVSL | SEQ ID No 1930 |
| VQYKAV | SEQ ID No 1931 |
| VQYKEI | SEQ ID No 1932 |
| VQYNIV | SEQ ID No 1933 |
| VQYRPV | SEQ ID No 1934 |
| VQYSQI | SEQ ID No 1935 |
| VQYSTV | SEQ ID No 1936 |
| VQYTEV | SEQ ID No 1937 |
| VQYYNI | SEQ ID No 1938 |
| VRYARL | SEQ ID No 1939 |
| VRYDNL | SEQ ID No 1940 |
| VRYGRI | SEQ ID No 1941 |
| VRYKKL | SEQ ID No 1942 |
| VRYKRV | SEQ ID No 1943 |
| VRYLDV | SEQ ID No 1944 |
| VRYRTI | SEQ ID No 1945 |
| VRYSDI | SEQ ID No 1946 |
| VRYTQL | SEQ ID No 1947 |
| VRYVCL | SEQ ID No 1948 |
| VSYAEL | SEQ ID No 1949 |
| VSYASV | SEQ ID No 1950 |

-continued

| | |
|---|---|
| VSYEPI | SEQ ID No 1951 |
| VSYGDI | SEQ ID No 1952 |
| VSYIGL | SEQ ID No 1953 |
| VSYILV | SEQ ID No 1954 |
| VSYMML | SEQ ID No 1955 |
| VSYNNI | SEQ ID No 1956 |
| VSYNNL | SEQ ID No 1957 |
| VSYQEI | SEQ ID No 1958 |
| VSYQPI | SEQ ID No 1959 |
| VSYSAV | SEQ ID No 1960 |
| VSYSFL | SEQ ID No 1961 |
| VSYSLV | SEQ ID No 1962 |
| VSYSPV | SEQ ID No 1963 |
| VSYTML | SEQ ID No 1964 |
| VSYTNL | SEQ ID No 1965 |
| VSYTPL | SEQ ID No 1966 |
| VSYVKI | SEQ ID No 1967 |
| VSYVLL | SEQ ID No 1968 |
| VTYADL | SEQ ID No 1969 |
| VTYAEL | SEQ ID No 1970 |
| VTYAEV | SEQ ID No 1971 |
| VTYAKV | SEQ ID No 1972 |
| VTYAPV | SEQ ID No 1973 |
| VTYAQL | SEQ ID No 1974 |
| VTYATL | SEQ ID No 1975 |
| VTYATV | SEQ ID No 1976 |
| VTYGNI | SEQ ID No 1977 |
| VTYITI | SEQ ID No 1978 |
| VTYQII | SEQ ID No 1979 |
| VTYQIL | SEQ ID No 1980 |
| VTYQLL | SEQ ID No 1981 |
| VTYSAL | SEQ ID No 1982 |
| VTYSTL | SEQ ID No 1983 |
| VTYTLL | SEQ ID No 1984 |
| VTYTQL | SEQ ID No 1985 |
| VTYVNL | SEQ ID No 1986 |
| VVYADI | SEQ ID No 1987 |
| VVYEDV | SEQ ID No 1988 |
| VVYFCL | SEQ ID No 1989 |
| VVYKTL | SEQ ID No 1990 |
| VVYQKL | SEQ ID No 1991 |

| | |
|---|---|
| VVYSEV | SEQ ID No 1992 |
| VVYSQV | SEQ ID No 1993 |
| VVYSVV | SEQ ID No 1994 |
| VVYTVL | SEQ ID No 1995 |
| VVYYRI | SEQ ID No 1996 |
| VYYHWL | SEQ ID No 1997 |
| VYYLPL | SEQ ID No 1998 |

In some embodiments, the ITIM, or at least one of the ITIMs when several ITIMs are present in the intracellular domain is selected from LSYRSL (SEQ ID NO: 1496), LPYYDL (SEQ ID NO: 1378), LLYSRL (SEQ ID NO: 1334), LIYTLL (SEQ ID NO: 1283), LLYADL (SEQ ID NO: 1303), ISYTTL (SEQ ID NO: 1116), VTYSAL (SEQ ID NO: 1982), IHYSEL (SEQ ID NO: 1059), VDYVIL (SEQ ID NO: 1832), LHYASL (SEQ ID NO: 1218), LDYDYL (SEQ ID NO: 1174), VDYDFL (SEQ ID NO: 1817), VTYSTL (SEQ ID NO: 1983), IIYSEV (SEQ ID NO: 1065), LEYLCL (SEQ ID NO: 1186), VLYGQL (SEQ ID NO: 1901), VPYTPL (SEQ ID NO: 1926), ISYPML (SEQ ID NO: 1115), VSYTNL (SEQ ID NO: 1965), LLYEMV (SEQ ID NO: 1016), VDYNLV (SEQ ID NO: 1825), ITYFAL (SEQ ID NO: 1017), VHYQSV (SEQ ID NO: 1859), VPYVMV (SEQ ID NO: 1929), IPYRTV (SEQ ID NO: 1089), IAYSLL (SEQ ID NO: 1026), VCYGRL (SEQ ID NO: 1813), LKYLYL (SEQ ID NO: 1294), LLYEHV (SEQ ID NO: 1307), ITYSLL (SEQ ID NO: 1125), VLYSEL (SEQ ID NO: 1905), IWYNIL (SEQ ID NO: 1140), ISYKGL (SEQ ID NO: 1018), IDYYNL (SEQ ID NO: 1035), LEYLQL (SEQ ID NO: 1189), LKYRGL (SEQ ID NO: 1301), VLYASV (SEQ ID NO: 1893), LQYLSL (SEQ ID NO: 1386), LFYRHL (SEQ ID NO: 1201), VQYKAV (SEQ ID NO: 1931), LSYSSL (SEQ ID NO: 1499), LSYTKV (SEQ ID NO: 1501), VQYSTV (SEQ ID NO: 1936), VKYNPV (SEQ ID NO: 1882), VVYSEV (SEQ ID NO: 1992), LEYVSV (SEQ ID NO: 1192), LAYHTV (SEQ ID NO: 1019), VQYLRL (SEQ ID NO: 1020), VTYTQL (SEQ ID NO: 1985), IVYTEL (SEQ ID NO: 1136), IVYAEL (SEQ ID NO: 1126), VTYAQL (SEQ ID NO: 1974), ILYTEL (SEQ ID NO: 1080), ITYAAV (SEQ ID NO: 1117), VIYIDV (SEQ ID NO: 1866), VTYAEV (SEQ ID NO: 1971), VTYAPV (SEQ ID NO: 1973), VTYAKV (SEQ ID NO: 1972), VTYARL (SEQ ID NO: 2038), ILYHTV (SEQ ID NO: 1076), VLYAML (SEQ ID NO: 1892), VIYAQL (SEQ ID NO: 1861), LVYENL (SEQ ID NO: 1527), LCYADL (SEQ ID NO: 1159), ISYASL (SEQ ID NO: 1108), LTYVLL (SEQ ID NO: 1021), VTYVNL (SEQ ID NO: 1986), VRYSIV (SEQ ID NO: 1022), VFYRQV (SEQ ID NO: 1845), LKYMEV (SEQ ID NO: 1295), VDYGEL (SEQ ID NO: 1820), LSYMDL (SEQ ID NO: 1487), VLYTAV (SEQ ID NO: 1907), VQYTEV (SEQ ID NO: 1937), IVYASL (SEQ ID NO: 1128), VEYLEV (SEQ ID NO: 1838), LEYVDL (SEQ ID NO: 1191), ITYADL (SEQ ID NO: 1118), LTYADL (SEQ ID NO: 1505), VIYENV (SEQ ID NO: 1863), LAYYTV (SEQ ID NO: 1158), VSYSAV (SEQ ID NO: 1960), LVYDKL (SEQ ID NO: 1525), LNYMVL (SEQ ID NO: 1356), LNYACL (SEQ ID NO: 1351), LDYINV (SEQ ID NO: 1177), LHYATL (SEQ ID NO: 1221), LHYAVL (SEQ ID NO: 1222), IQYAPL (SEQ ID NO: 1093), IQYASL (SEQ ID NO: 1094), LLYLLL (SEQ ID NO: 1023), VVYSQV (SEQ ID NO: 1993), VIYSSV (SEQ ID NO: 1873), VVYYRV (SEQ ID NO: 2039), VPYVEL (SEQ ID NO: 1928), LDYDKL (SEQ ID NO: 1173), LSYPVL (SEQ ID NO: 1492), VAYSQV (SEQ ID NO: 1810), LFYWDV (SEQ ID NO: 1203), LIYSQV (SEQ ID NO: 2040), or LDYEFL (SEQ ID NO: 1176).

In some embodiments, p is 1, 2, 3, 4, 5, 6, 7, 8, 9, 10, 11, 12, 13, 14, 15, 16, 17, 18, 19 or 20. In some embodiments, p is 1, 2, 3, 4, 5, 6, 7, 8, 9, or 10. In some embodiments, p is 1, 2, 3, 4 or 5. In some embodiments, p is 1. In some embodiments, p is 2. In some embodiments, p is 3. In some embodiments, p is 4. In some embodiments, p is 5.

In some embodiments, n is 1, 2, 3, 4, 5, 6, 7, 8, 9, or 10. In some embodiments, n is 1, 2, 3, 4 or 5. In some embodiments, n is 0. In some embodiments, n is 1. In some embodiments, n is 2. In some embodiments, n is 3.

In some embodiments, m is 1, 2, 3, 4, 5, 6, 7, 8, 9, 10, 11, 12, 13, 14, 15, 16, 17, 18, 19 or 20. In some embodiments, m is 1, 2, 3, 4, 5, 6, 7, 8, 9, or 10. In some embodiments, m is 1, 2, 3, 4 or 5. In some embodiments, m is 1. In some embodiments, m is 2. In some embodiments, m is 3. In some embodiments, m is 4. In some embodiments, m is 5.

In some embodiments, n is 1 and m is 1.

In some embodiments, n is 1 and m is 1 and p is 1 to 10.

In some embodiments, n is 1 and m is 1 and p is 1.

In some embodiments, n is 0 and m is 1 and p is 1 to 20.

In some embodiments, n is 0, m is 1 to 6 and p is 1.

In some embodiments, n is 0, m is 1 and p is 1.

In some embodiments, n is 0, m is 2 and p is 1.

In some embodiments, n is 0, m is 3 and p is 1.

In some embodiments, n is 0, m is 4 and p is 1.

In some embodiments, n is 0, m is 5 and p is 1.

In some embodiments, n is 0, m is 6 and p is 1.

In some embodiments, n is 0, m is 1 to 6 and p is 1 and ITSM is TEYATI (SEQ ID NO: 937).

In some embodiments, n is 0, m is 1 to 6 and p is 1 and ITSM is TEYSEI (SEQ ID NO: 940).

In some embodiments, n is 0, m is 1 to 6 and p is 1 and ITSM is TVYSEV (SEQ ID NO: 1011).

In some embodiments, n is 1, m is 1 and p is 1 to 5.

In some embodiments, n is 1, m is 1 and p is 1.

In some embodiments, n is 1, m is 1 and p is 2.

In some embodiments, n is 1, m is 1 and p is 3.

In some embodiments, n is 1, m is 1 and p is 4.

In some embodiments, n is 1, m is 1 and p is 5.

In some embodiments, n is 1, m is 1 and p is 1 to 5 and ITIM is VDYGEL (SEQ ID NO: 1820) and ITSM is TEYATI (SEQ ID NO: 937).

In some embodiments, n is 1, m is 1 and p is 1 to 5 and ITIM is $LX_6YAX_8L$ (SEQ ID NO: 2041) wherein $X_6$ is selected from H or Q and $X_8$ is V or S, and ITSM is TEYSEI (SEQ ID NO: 940).

In some embodiments, n is 1, m is 1 and p is 1 to 5 and ITIM is $LX_6YAX_8L$ (SEQ ID NO: 2041) wherein $X_6$ is selected from H or Q and $X_8$ is V or S, and ITSM is TEYASI (SEQ ID NO: 936).

In some embodiments, n is 1, m is 1 and p is 1 to 5 and ITIM is $LX_6YAX_8L$ (SEQ ID NO: 2041) wherein $X_6$ is selected from H or Q and $X_8$ is V or S, and ITSM is TVYSEV (SEQ ID NO: 1011).

In some embodiments, the intracellular domain comprises several ITSMs having the same amino acid sequence.

In some embodiments, the intracellular domain comprises several ITSMs having different amino acid sequences.

In some embodiments, the intracellular domain comprises several ITIMs having the same amino acid sequence.

In some embodiments, the intracellular domain comprises several ITIMs having different amino acid sequences.

In some embodiments, the intracellular domain of the NCAR is selected from SEQ ID No 2000, SEQ ID No 2001, SEQ ID No 2002, SEQ ID No 2003, SEQ ID No 2004, SEQ ID No 2005, SEQ ID No 2006, SEQ ID No 2007, SEQ ID No 2008, SEQ ID No 2009, SEQ ID No 2010, SEQ ID No 2011, SEQ ID No 2012, SEQ ID No 2013, SEQ ID No 2014, SEQ ID No 2015, SEQ ID No 2016 and SEQ ID No 2017.

TABLE 1

Naturally occurring N-terminal flanking region of ITIM.*ITSM intracellular domains varying in length from 1-520 (Table 1 comprises SEQ ID No 1 to SEQ ID No 36)

N

| Sequence | ID |
|---|---|
| ELFANKRKYT | SEQ ID No 1 |
| RKRNNSRLGNG | SEQ ID No 2 |
| YRHRKKRNGLT | SEQ ID No 3 |
| YKMYGSEMLHKRDPLDEDEDTD | SEQ ID No 4 |
| LRKRRDSLSLSTQRTQGPAESARN | SEQ ID No 5 |
| WRMMKYQQKAAGMSPEQVLQPLEGD | SEQ ID No 6 |
| CSRAARGTIGARRTGQPLKEDPSAVPVFS | SEQ ID No 7 |
| RIRQKKAQGSTSSTRLHEPEKNAREITQDTND | SEQ ID No 8 |
| NNSYQEIEEDADVEWKFARAKLWLSYFDEGRTLPAPFNLVPSPK | SEQ ID No 9 |
| WLHRRLPPQPIRPLPRFAPLVKTEPQRPVKEEEPKIPGDLDQEPS | SEQ ID No 10 |
| SNKCDVVVVGGGISGMAAAKLLHDSGLNVVVLEARDRVGGRTYTLRNQK | SEQ ID No 11 |
| KTHRRKAARTAVGRNDTHPTTGSASPKHQKKSKLHGPTETSSCSGAAPT VEMDEE | SEQ ID No 12 |
| RVKTRRKKAAQPVQNTDDVNPVMVSGSRGHQHQFQTGIVSDHPAEAGPI SEDEQE | SEQ ID No 13 |
| KARRKQAAGRPEKMDDEDPIMGTITSGSRKKPWPDSPGDQASPPGDAP PLEEQKE | SEQ ID No 14 |
| KICRKEARKRAAAEQDVPSTLGPISQGHQHECSAGSSQDHPPPGAATYT PGKGEEQE | SEQ ID No 15 |
| MENQEKASIAGHMFDVVVIGGGISGLSAAKLLTEYGVSVLVLEARDRVGG RTYTIRNEH | SEQ ID No 16 |
| VRSCRKKSARPAAGVGDTGIEDANAVRGSASQGPLTEPWAEDSPPDQP PPASARSSVGEGE | SEQ ID No 17 |
| KCYFLRKAKAKQMPVEMSRPAVPLLNSNNEKMSDPNMEANSHYGHNDD VRNHAMKPINDNKEPLNSD | SEQ ID No 18 |
| VRLRLQKHRPPADPCRGETETMNNLANCQREKDISVSIIGATQIKNTNKKA DFHGDHSADKNGFKARYPA | SEQ ID No 19 |
| RRHQGKQNELSDTAGREINLVDAHLKSEQTEASTRQNSQVLLSETGIYDN DPDLCFRMQEGSEVYSNPCLEENKPG | SEQ ID No 20 |
| QSVFNKRKSRVRHYLVKCPQNSSGETVTSVTSLAPLQPKKGKRQKEKPDI PPAVPAKAPIAPTFHKPKLLKPQRKVTLPKIAEEN | SEQ ID No 21 |
| MSDKMSSFLHIGDICSLYAEGSTNGFISTLGLVDDRCVVQPETGDLNNPP KKFRDCLFKLCPMNRYSAQKQFWKAAKPGANSTTDAVLLNKLHHAADLE KKQNETENRKLLGTV | SEQ ID No 22 |
| MTEKMSSFLYIGDIVSLYAEGSVNGFISTLGLVDDRCVVHPEAGDLANPPK KFRDCLFKVCPMNRYSAQKQYWKAKQAKQGNHTEAALLKKLQHAAELE QKQNESENKKLLGEI | SEQ ID No 23 |
| MSEMSSFLHIGDIVSLYAEGSVNGFISTLGLVDDRCVVEPAAGDLDNPPKK FRDCLFKVCPMNRYSAQKQYWKAKQTKQDKEKIADVVLLQKLQHAAQME QKQNDTENKKVHGDV | SEQ ID No 24 |

TABLE 1-continued

Naturally occurring N-terminal flanking region of ITIM.*ITSM intracellular domains varying in length from 1-520 (Table 1 comprises SEQ ID No 1 to SEQ ID No 36)

| Sequence | ID |
|---|---|
| NCVSCCKDPEIDFKEFEDNFDDEIDFTPPAEDTPSVQSPAEVFTLSVPNIS LPAPSQFQPSVEGLKSQVARHSLNYIQEIGNGWFGKVLLGEIYTGTSVAR VIVKELKASANPKEQDTFLKNGEPYYILQHPNILQCVGQCVEA | SEQ ID No 25 |
| KRVQETKFGNAFTEEDSELVVNYIAKKSFCRRAIELTLHSLGVSEELQNKL EDVVIDRNLLILGKILGEGEF GSVMEGNLKQEDGTSLKVAVKTMKLDNSSQREIEEFLSEAACMKDFSHP NVIRLLGVCIEMSSQGIPKPMVILPFMKYGDLHTY | SEQ ID No 26 |
| HRRKKETRYGEVFEPTVERGELVVRYRVRKSYSRRTTEATLNSLGISEEL KEKLRDVMVDRHKVALGKTLGEGEFGAVMEGQLNQDDSILKVAVKTMKIA ICTRSELEDFLSEAVCMKEFDHPNVMRLIGVCFQGSERESFPAPVVILPFM KHGDLHSF | SEQ ID No 27 |
| MSGGASATGPRRGPPGLEDTTSKKKQKDRANQESKDGDPRKETGSRYV AQAGLEPLASGDPSASASHAAGITGSRHRTRLFFPSSSGSASTPQEEQTK EGACEDPHDLLATPTPELLLDWRQSAEEVIVKLRVGVGPLQLEDVDAAFT DTDCVVRFAGGQQWGG | SEQ ID No 28 |
| AYKRKSRESDLTLKRLQMQMDNLESRVALECKEAFAELQTDIHELTSDLD GAGIPFLDYRTYTMRVLFPGIEDHPVLRDLEVPGYRQERVEKGLKLFAQLI NNKVFLLSFIRTLESQRSFSMRDRGNVASLIMTVLQSKLEYATDVLKQLLA DLIDKNLESKNHPKLLLRRTESVAEKMLTNWFTF | SEQ ID No 29 |
| YKRKTQDADRTLKRLQLQMDNLESRVALECKEAFAELQTDINELTNHMDE VQIPFLDYRTYAVRVLFPGIEAHPVLKELDTPPNVEKALRLFGQLLHSRAFV LTFIHTLEAQSSFSMRDRGTVASLTMVALQSRLDYATGLLKQLLADLIEKNL ESKNHPKLLLRRTESVAEKMLTNWFTFLLHKFLKECAGEPLF | SEQ ID No 30 |
| RWHCPRRLLGACWTLNGQEEPVSQPTPQLENEVSRQHLPATLPEMVAF YQELHTPTQGQTMVRQLMHKLLVFSAREVDHRGGCLMLQDTGISLLIPPG AVAVGRQERVSLILVWDLSDAPSLSQAQGLVSPVVACGPHGASFLKPCTL TFKHCAEQPSHARTYSSNTTLLDAKVWRPLGRPGAHASRDECRIHLSHF | SEQ ID No 31 |
| KQKPRYEIRWRVIESISPDGHEYIYVDPMQLPYDSRWEFPRDGLVLGRVL GSGAFGKVVEGTAYGLSRSQPVMKVAVKMLKPTARSSEKQALMSELKIM THLGPHLNIVNLLGACTKSGPIYIITEYCFYGDLVNYLHKNRDSFLSHHPEK PKKELDIFGLNPADESTRSYVILSFENNGDYMDMKQADTTQYVPMLERKEV | SEQ ID No 32 |
| MFNYTFQQVQEHTDQIWKFQRHDLIEEYHGRPAAPPPFILLSHLQLFIKRV VLKTPAKRHKQLKNKLEKNEEAALLSWEIYLKENYLQNRQFQQKQRPEQK IEDISNKVDAMVDLLDLDPLKRSGSMEQRLASLEEQVAQTAQALHWIVRTL RASGFSSEADVPTLASQKAAEEPDAEPGGRKKTEEPGDSYHVNARHLLY PNCPVTRFPVPNEKVPWETEFLIYDPPFYTAERKDAAAMDPMGDTLEPLST | SEQ ID No 33 |
| CCDCGGAPRSAAGFEPVPECSDGAIHSWAVEGPQPEPRDITTVIPQIPPD NANIIECIDNSGVYTNEYGGREMQDLGGGERMTGFELTEGVKTSGMPEIC QEYSGTLRRNSMRECREGGLNMNFMESYFCQKAYAYADEDEGRPSNDC LLIYDIEGVGSPAGSVGCCSFIGEDLDDSFLDTLGPKFKKLADISLGKESYP DLDPSWPPQSTEPVCLPQETEPVVSGHPPISPHFGTTTVISESTYPSGPG VLHPKPILDP | SEQ ID No 34 |
| MADGGEGEDEIQFLRTDDEVVLQCTATIHKEQQKLCLAAEGFGNRLCFLE STSNSKNVPPDLSICTFVLEQSLSVRALQEMLANTVEKSEGQVDVEKWKF MMKTAQGGGHRTLLYGHAILLRHSYSGMYLCCLSTSRSSTDKLAFDVGL QEDTTGEACWWTIHPASKQRSEGEKVRVGDDLILVSVSSERYLHLSYGN GSLHVDAAFQQTLWSVAPISSGSEAAQGYLIGGDVLRLLHGHMDECLTVP SGEHGEEQRRTVHYEGGAVSVHARSLWRLETLRVAWSGSHIRWGQPFR LRHVTTGKYLSLMEDKNLLLMDKEKADVKSTAFTFRSSKEKLDVGVRKEV DGMGTSEIKYGDSVCYIQHVDTGLW | SEQ ID No 35 |
| MGDAEGEDEVQFLRTDDEVVLQCSATVLKEQLKLCLAAEGFGNRLCFLE PTSNAQNVPPDLAICCFVLEQSLSVRALQEMLANTVEAGVESSQGGHR TLLYGHAILLRHAHSRMYLSCLTTSRSMTDKLAFDVGLQEDATGEACWWT MHPASKQRSEGEKVRVGDDIILVSVSSERYLHLSTASGELQVDASFMQTL WNMNPICSRCEEGFVTGGHVLRLFHGHMDECLTISPADSDDQRRLVYYE GGAVCTHARSLWRLEPLRISWSGSHLRWGQPLRVRHVTTGQYLALTEDQ GLVVVDASKAHTKATSFCFRISKEKLDVAPKRDVEGMGPPEIKYGESLCF VQHVASGLWLTYAAPDPKALRLGVLKKKAMLHQEGHMDDALSLTRCQQE ESQAARMIHSTNGLYNQFIKSLDSFSGKPRGSGPPAGTALPIEGVILSLQD LIIYFEPPSEDLQHEEKQSKLRSLRNRQSLFEEGMLSMVLNCIDRLNVYT TAAHFAEFAGEEAAESWKEIVN | SEQ ID No 36 |

TABLE 2

Examples of intracellular domains of known inhibitory receptors

| | |
|---|---|
| CTLA4 | AVSLSKMLKKRSPLTTGVYVKMPPTEPECEKQFQPYFIPIN (SEQ ID No 37) |
| LAG3 | HLWRRQWRPRRFSALEQGIHPPQAQSKIEELEQEPEPEPEPEPEPEPEPE QL (SEQ ID No 38) |
| HAVCR2 (TIM3) | FKWYSHSKEKIQNLSLISLANLPPSGLANAVAEGIRSEENIYTIEENVYEVEEPNE YYCYVSSRQQPSQPLGCRFAMP (SEQ ID No 39) |
| LAIR1 | HRQNQIKQGPPRSKDEEQKPQQRPDLAVDVLERTADKATVNGLPEKDRETDT SALAAGSSQEVTYAQLDHWALTQRTARAVSPQSTKPMAESITYAAVARH (SEQ ID No 40) |
| KIR2DL2 | HRWCSNKKNAAVMDQESAGNRTANSEDSDEQDPQEVTYTQLNHCVFTQRKI TRPSQRPKTPPTDIIVYAELPNAESRSKVVSCP (SEQ ID No 41) |
| LILRB1 | LRHRRQGKHWTSTQRKADFQHPAGAVGPEPTDRGLQWRSSPAADAQEENLY AAVKHTQPEDGVEMDTRSPHDEDPQAVTYAEVKHSRPRREMASPPSPLSGEF LDTKDRQAEEDRQMDTEAAASEAPQDVTYAQLHSLTLRREATEPPPSQEGPS PAVPSIYATLAIH (SEQ ID No 2021) |
| TIGIT | LTRKKKALRIHSVEGDLRRKSAGQEEWSPSAPSPPGSCVQAEAAPAGLCGEQ RGEDCAELHDYFNVLSYRSLGNCSFFTETG (SEQ ID No 2022) |
| CEACAM1 | HFGKTGRASDQRDLTEHKPSVSNHTQDHSNDPPNKMNEVTYSTLNFEAQQPT QPTSASPSLTATEIIYSEVKKQ (SEQ ID No 2023) |
| CSF1R | KYKQKPKYQVRWKIIESYEGNSYTFIDPTQLPYNEKWEFPRNNLQFGKTLGAG AFGKVVEATAFGLGKEDAVLKVAVKMLKSTAHADEKEALMSELKIMSHLGQHE NIVNLLGACTHGGPVLVITEYCCYGDLLNFLRRKAEAMLGPSLSPGQDPEGGV DYKNIHLEKKYVRRDSGFSSQGVDTYVEMRPVSTSSNDSFSEQDLDKEDGRP LELRDLLHFSSQVAQGMAFLASKNCIHRDVAARNVLLTNGHVAKIGDFGLARDI MNDSNYIVKGNARLPVKWMAPESIFDCVYTVQSDVWSYGILLWEIFSLGLNPY PGILVNSKFYKLVKDGYQMAQPAFAPKNIYSIMQACWALEPTHRPTFQQICSFL QEQAQEDRRERDYTNLPSSSRSGGSGSSSSELEEESSSEHLTCCEQGDIAQP LLQPNNYQFC ((SEQ ID No 2024) |
| CD5 | KKLVKKFRQKKQRQWIGPTGMNQNMSFHRNHTATVRSHAENPTASHVDNEY SQPPRNSHLSAYPALEGALHRSSMQPDNSSDSDYDLHGAQRL ((SEQ ID No 2025) |
| CD96 | RKWCQYQKEIMERPPPFKPPPPPIKYTCIQEPNESDLPYHEMETL (SEQ ID No 2026) |
| CD22 | KLQRRWKRTQSQQGLQENSSGQSFFVRNKKVRRAPLSEGPHSLGCYNPMME DGISYTTLRFPEMNIPRTGDAESSEMQRPPPDCDDTVTYSALHKRQVGDYENV IPDFPEDEGIHYSELIQFGVGERPQAQENVDYVILKH (SEQ ID No 2027) |

TABLE 3

Examples of naturally occurring N-terminal flanking regions of ITIM only intracellular domains varying in length from 0 to 4211 (Table 3 comprises SEQ ID No 42 to SEQ ID No 351)

K

V

Q

V

T

F

Y

LL

QP

EH

NL

KW

TABLE 3-continued

Examples of naturally occurring N-terminal flanking regions of ITIM only intracellular domains varying in length from 0 to 4211 (Table 3 comprises SEQ ID No 42 to SEQ ID No 351)

| | |
|---|---|
| LV | |
| NP | |
| TF | |
| RL | |
| LNP | |
| KCP | |
| ETL | |
| RRA | |
| MAQ | |
| RRRP | SEQ ID No 42 |
| MSEE | SEQ ID No 43 |
| MTSE | SEQ ID No 44 |
| DRYL | SEQ ID No 45 |
| MTDS | SEQ ID No 46 |
| AAKP | SEQ ID No 47 |
| QHFS | SEQ ID No 48 |
| MKPK | SEQ ID No 49 |
| IAAL | SEQ ID No 50 |
| CLNP | SEQ ID No 51 |
| QKVL | SEQ ID No 52 |
| DRYQS | SEQ ID No 53 |
| LKAKD | SEQ ID No 54 |
| DRYYA | SEQ ID No 55 |
| MSYYG | SEQ ID No 56 |
| SSSKP | SEQ ID No 57 |
| LKIRH | SEQ ID No 58 |
| DVRHV | SEQ ID No 59 |
| DRFYA | SEQ ID No 60 |
| EGWRI | SEQ ID No 61 |
| SDIKR | SEQ ID No 62 |
| LHHKKY | SEQ ID No 63 |
| TVDRYL | SEQ ID No 64 |
| SSPTFR | SEQ ID No 65 |
| WRRAGH | SEQ ID No 66 |
| YRVDLV | SEQ ID No 67 |
| NSFDLA | SEQ ID No 68 |
| YRSGIT | SEQ ID No 69 |
| YRLGLT | SEQ ID No 70 |

TABLE 3-continued

Examples of naturally occurring N-terminal flanking regions of ITIM only intracellular domains varying in length from 0 to 4211 (Table 3 comprises SEQ ID No 42 to SEQ ID No 351)

| | |
|---|---|
| QHIMAI | SEQ ID No 71 |
| NSCANP | SEQ ID No 72 |
| RRFCAT | SEQ ID No 73 |
| GDMANNS | SEQ ID No 74 |
| MAYQSLR | SEQ ID No 75 |
| TARNLTV | SEQ ID No 76 |
| MERAEEP | SEQ ID No 77 |
| SMDRFLA | SEQ ID No 78 |
| LRLAAAP | SEQ ID No 79 |
| LRLFAAP | SEQ ID No 80 |
| KRLIALS | SEQ ID No 81 |
| YSNSSVNP | SEQ ID No 82 |
| YANSCVNP | SEQ ID No 83 |
| KLSPRVKR | SEQ ID No 84 |
| KIRLRCQS | SEQ ID No 85 |
| SCDLLTAF | SEQ ID No 86 |
| MASESSPL | SEQ ID No 87 |
| KTANEGGS | SEQ ID No 88 |
| DFAKEGHS | SEQ ID No 89 |
| DHVRRKDS | SEQ ID No 90 |
| DNVKKENS | SEQ ID No 91 |
| VMWKHRYQ | SEQ ID No 92 |
| KMYYSRRG | SEQ ID No 93 |
| DRYIAIRIP | SEQ ID No 94 |
| DRYLAICVP | SEQ ID No 95 |
| DRYLRVKLT | SEQ ID No 96 |
| DRYIGVSYP | SEQ ID No 97 |
| DRYIGVRYS | SEQ ID No 98 |
| DRYVGVRHS | SEQ ID No 99 |
| DRYLAVTNP | SEQ ID No 100 |
| MPFHPVTAA | SEQ ID No 101 |
| DRYISIHRP | SEQ ID No 102 |
| MQLKILVSA | SEQ ID No 103 |
| WKQRRAKEK | SEQ ID No 104 |
| DRFIAVVHP | SEQ ID No 105 |
| DRYIAITKP | SEQ ID No 106 |
| NRYCYICHS | SEQ ID No 107 |
| DRYLAITKP | SEQ ID No 108 |

TABLE 3-continued

Examples of naturally occurring N-terminal flanking regions of ITIM only intracellular domains varying in length from 0 to 4211 (Table 3 comprises SEQ ID No 42 to SEQ ID No 351)

| | |
|---|---|
| DRYCAVMDP | SEQ ID No 109 |
| DRYISIFYA | SEQ ID No 110 |
| DRYITIFHA | SEQ ID No 111 |
| NRYCYICHS | SEQ ID No 112 |
| WKKICNKSS | SEQ ID No 113 |
| WCYRKRYFV | SEQ ID No 114 |
| AHSNSCLNP | SEQ ID No 115 |
| PVFYKLGIT | SEQ ID No 116 |
| KFHRSRRLLG | SEQ ID No 117 |
| VDRYLRVKIP | SEQ ID No 118 |
| FERSCRKENM | SEQ ID No 119 |
| LPSIYLVFLI | SEQ ID No 120 |
| SSKTFQTWQS | SEQ ID No 121 |
| IDRYIAVCHP | SEQ ID No 122 |
| SFCLRNLFFP | SEQ ID No 123 |
| LLKTAKEGGS | SEQ ID No 124 |
| MWRNSKVMNI | SEQ ID No 125 |
| VEKKLFIHEYI | SEQ ID No 126 |
| RKRNNSRLGNG | SEQ ID No 127 |
| QRITVHVTRRP | SEQ ID No 128 |
| MEAAHAKTTEEC | SEQ ID No 129 |
| MARISFSYLCPA | SEQ ID No 130 |
| CCKRQKGKPKRK | SEQ ID No 131 |
| MTGDKGPQRLSG | SEQ ID No 132 |
| PDIPQSVKNKVLE | SEQ ID No 133 |
| KIFKIDIVLWYRD | SEQ ID No 134 |
| TEYVVRLWSAGCR | SEQ ID No 135 |
| QSKSELSHYTFYF | SEQ ID No 136 |
| SIVAYKQVPL | SEQ ID No 137 |
| SLDFFGSQNTQDD | SEQ ID No 138 |
| LWLHNGRSCFGVNR | SEQ ID No 139 |
| RFLRLNLKPDLSDT | SEQ ID No 140 |
| REHQRSGSYHVREE | SEQ ID No 141 |
| MITLTELKCLADAQ | SEQ ID No 142 |
| YNLTRLCRWDKRLL | SEQ ID No 143 |
| AFMNENFKKNVLSA | SEQ ID No 144 |
| MIYRLAQAEERQQLE | SEQ ID No 145 |
| KFRKNFWKLVKDIGC | SEQ ID No 146 |

TABLE 3-continued

Examples of naturally occurring N-terminal flanking regions of ITIM only intracellular domains varying in length from 0 to 4211 (Table 3 comprises SEQ ID No 42 to SEQ ID No 351)

| Sequence | SEQ ID |
|---|---|
| ALALAALAAVEPACG | SEQ ID No 147 |
| KKIAAATETAAQENA | SEQ ID No 148 |
| YRKVSKAEEAAQENA | SEQ ID No 149 |
| LKDFSILLMEGVPKS | SEQ ID No 150 |
| TVATAVEQYVPSEKL | SEQ ID No 151 |
| MGRQKELVSRCGEMLH | SEQ ID No 152 |
| CKRRGQSPQSSPDLP | SEQ ID No 153 |
| LLEGVHLFLTARNLTV | SEQ ID No 154 |
| EERERKHHLKHGPNAP | SEQ ID No 155 |
| PLTHRLLCSEEPPRLH | SEQ ID No 156 |
| LYLLVRKHINRAHTAL | SEQ ID No 157 |
| KLPLWGQPSDQNCYDD | SEQ ID No 158 |
| MYRLKVLQMRLRSAITG | SEQ ID No 159 |
| SMRGTICNPGPRKSMSK | SEQ ID No 160 |
| RILVRKLEPAQGSLHTQ | SEQ ID No 161 |
| SRYATLMQKDSSQETT | SEQ ID No 162 |
| SSHFGCQLVCCQSSNVS | SEQ ID No 163 |
| RILMRKLRTQETRGNEV | SEQ ID No 164 |
| RILLQKLRPPDIRKSDS | SEQ ID No 165 |
| RILLQKLTSPDVGGNDQ | SEQ ID No 166 |
| RSVRPCFTQAAFLKSKYW | SEQ ID No 167 |
| RSGRGRKLSGDQITLPTT | SEQ ID No 168 |
| MAAENEASQESALGAYSP | SEQ ID No 169 |
| TAHVFSCLSLRLRAAFFY | SEQ ID No 170 |
| NPFIYSRNSAGLRRKVLWC | SEQ ID No 171 |
| NNESSNNPSSIASFLSSITY | SEQ ID No 172 |
| TPQLFINYKLKSVAHLPWRM | SEQ ID No 173 |
| WRLKPSADCGPFRGLPLFIH | SEQ ID No 174 |
| NIPLLFYHLWRYFHRPADGSE | SEQ ID No 175 |
| SQVTKSSPEQSYQGDMYPTRG | SEQ ID No 176 |
| CCSALQKRCRKCFNKDSTEAT | SEQ ID No 177 |
| CQRLAARLGVVTGKDLGEVCH | SEQ ID No 178 |
| QVFRNISGKQSSLPAMSKVRR | SEQ ID No 179 |
| GGRREGESWNWAWVLSTRLARH | SEQ ID No 180 |
| YKMYGSEMLHKRDPLDEDEDTD | SEQ ID No 181 |
| HMYRERGGELLVHTGFLGSSQDR | SEQ ID No 182 |
| RKWCQYQKEIMERPPPFKPPPPP | SEQ ID No 183 |
| HNKRKIFLLVQSRKWRDGLCSKT | SEQ ID No 184 |

TABLE 3-continued

Examples of naturally occurring N-terminal flanking regions
of ITIM only intracellular domains varying in length from
0 to 4211 (Table 3 comprises SEQ ID No 42 to SEQ ID No 351)

| Sequence | SEQ ID |
|---|---|
| RAARRRPEHLDTPDTPPRSQAQE | SEQ ID No 185 |
| NGTCFTAGRLIYVAGREGHMLKV | SEQ ID No 186 |
| DANYEMPGETLKVRYWPRDSWPVG | SEQ ID No 187 |
| ARSQMARNIWYFVVS | SEQ ID No 188 |
| LRKRRDSLSLSTQRTQGPAESARN | SEQ ID No 189 |
| DAASEIPEQGPVIKFWPNEKWAFIG | SEQ ID No 190 |
| WGYKNYREQRQLPQGDYVKKPGDGD | SEQ ID No 191 |
| TSYYSFVSHLRKIRTCTSIMEKD | SEQ ID No 192 |
| LIVRALIYKDLDNSPLRRK | SEQ ID No 193 |
| DHWALTQRTARAVSPQSTKPMAES | SEQ ID No 194 |
| HHNKRKIIAFVLEGKRSKVTRRPKA | SEQ ID No 195 |
| EWKSPFGLTPKGRNRSKVFSFSSALN | SEQ ID No 196 |
| YFLGRLVPRGRGAAEAATRKQRITETE | SEQ ID No 197 |
| QATACRTCHRQQQPAACRGFARVARTIL | SEQ ID No 198 |
| NKFSKYYQKQKDIDVDQCSEDAPEKCHE | SEQ ID No 199 |
| SKCSREVLWHCHLCPSSTEHASASANGH | SEQ ID No 200 |
| DMGSSDGETTHDSQITQEAVPKSLGASE | SEQ ID No 201 |
| CSRAARGTIGARRTGQPLKEDPSAVPVFS | SEQ ID No 202 |
| SVQKLSEFLSSAEIREEQCAPHEPTPQGPA | SEQ ID No 203 |
| KCYKIEIMLFYRNHFGAEELDGDNKDYDAY | SEQ ID No 204 |
| KCYNIELMLFYRQHFGADETNDDNKEYDAY | SEQ ID No 205 |
| GWKLRSYKTLFDAAETMVSLQLGIFNYEEV | SEQ ID No 206 |
| SSFSSCKDVTAEENNEAKNLQLAVARIKKG | SEQ ID No 207 |
| MRTKAAGCAERRPLQPRTEAAAAPAGRAMP | SEQ ID No 208 |
| RKRWQNEKLGLDAGDEYEDENLYEGLNLDDC | SEQ ID No 209 |
| MASHEVDNAELGSASAHGTPGSEAGPEELNT | SEQ ID No 210 |
| NGHPTSNAALFFIERRPHHWPAMKFRSHPDH | SEQ ID No 211 |
| ALLNNIIEIRLDAKKFVTELRRPVAVRAKDIG | SEQ ID No 212 |
| PETKGQSLAEIDQQFQKRRFTLSFGHRQNSTG | SEQ ID No 213 |
| PETKGKKLEEIESLFDNRLCTCGTSDSDEGRY | SEQ ID No 214 |
| YNLMSQKFRAAFRKLCNCKQKPTEKPANYSVA | SEQ ID No 215 |
| NYIFFGRGPQRQKKAAEKAASANNEKMRLDVNK | SEQ ID No 216 |
| DLNESANSTAQYASNAWFAAASSEPEEGISVFE | SEQ ID No 217 |
| DLNESANSTAQYASNAWFAAASSEPEEGISVFE | SEQ ID No 218 |
| SYQQKKFCFSIQQGLNADYVKGENLEAVVCEEPQ | SEQ ID No 219 |
| MDGSGERSLPEPGSQSSAASDDIEIVVNVGGVRQ | SEQ ID No 220 |
| RWCSKKKDAAVMNQEPAGHRTVNREDSDEQDPQE | SEQ ID No 221 |
| MFCSEKKLREVERIVKANDREYNEKFQYADNRIHT | SEQ ID No 222 |

TABLE 3-continued

Examples of naturally occurring N-terminal flanking regions of ITIM only intracellular domains varying in length from 0 to 4211 (Table 3 comprises SEQ ID No 42 to SEQ ID No 351)

| Sequence | SEQ ID |
|---|---|
| TQFSETKQRESQLMREQRVRFLSNASTLASFSEPG | SEQ ID No 223 |
| NWLNPPRLQMGSMTSTTLYNSMWFVYGSFVQQGGE | SEQ ID No 224 |
| CFYIKKINPLKEKSIILPKSLISVVRSATLETKPE | SEQ ID No 225 |
| HRWCANKKNAVVMDQEPAGNRTVNREDSDEQDPQE | SEQ ID No 226 |
| NYYSSCRKPTTTKKTTSLLHPDSSRWIPERISLQAP | SEQ ID No 227 |
| HLTALFLTVYEWRSPYGLTPRGRNRSTVFSYSSALN | SEQ ID No 228 |
| YFFIRTLQAHHDRSERESPFSGSSRQPDSLSSIENA | SEQ ID No 229 |
| LHCCCSNKKNAAVMDQEPAGDRTVNREDSDDQDPQE | SEQ ID No 230 |
| HYLRFQRKSIDGSFGSNDGSGNMVASHPIAASTPEG | SEQ ID No 231 |
| RWWNQYENLPWPDRLMSLVSGFVEGKDEQGRLLRRTL | SEQ ID No 232 |
| DVDVDDTTEEQGYGMAYTVHKWSELSWASHWVTFGCW | SEQ ID No 233 |
| RYCWLRRQAALQRRLSAMEKGKLHKPGKDASKRGRQTP | SEQ ID No 234 |
| MKKAEMGRFSISPDEDSSSYSSNSDFNYSYPTKQAALK | SEQ ID No 235 |
| LKCLIVALPKIILAVKSKGKFYLVIEELSQLFRSLVPIQ | SEQ ID No 236 |
| ETLLNAPRAMGTSSSPPSPASVVAPGTTLFEESRLPVFT | SEQ ID No 237 |
| YVRSWRKAGPLPSQIPPTAPGGEQCPLYANVHHQKGKDEG | SEQ ID No 238 |
| TYLSEPLVRGYTTAAAVQVFVSQLKYVFGLHLSSHSGPLS | SEQ ID No 239 |
| RWWSQYTSIPLPDQLMCVISASVHGVDQRGRLLRRTL | SEQ ID No 240 |
| RRFRQACLETCARCCPRPPRARPRALPDEDPPTPSIASLSR | SEQ ID No 241 |
| MAEAITYADLRFVKAPLKKSISSRLGQDPGADDDGE | SEQ ID No 242 |
| MQTSEREGSGPELSPSVMPEAPLESPPFPTKSPAFDLFNLV | SEQ ID No 243 |
| SKEKQFRGLQSRIEQEQKFTVIRGGQVIQIPVADITVGDIAQ | SEQ ID No 244 |
| SKEKQFRGLQSRIEQEQKFTVVRAGQVVQIPVAEIVVGDIAQ | SEQ ID No 245 |
| SKEKQFRGLQCRIEQEQKFSIIRNGQLIQLPVAEIVVGDIAQ | SEQ ID No 246 |
| KCLQGNADGDGGGQCCRRQDSPSPDFYKQSSPNLQVSSDGT | SEQ ID No 247 |
| SSECQRYVYSILCCKESSDPSSYNSSGQLMASKMDTCSSNLNN | SEQ ID No 248 |
| MDNQGVIYSDLNLPPNPKRQQRKPKGNKNSILATEQE | SEQ ID No 249 |
| WWGDIWWKTMMELRSLDTQKATCHLQQVTDLPWTSVSSPVERE | SEQ ID No 250 |
| RLLFSKTYKLQERSDLTVKEKEELIEEWQPEPLVPPVPKDHPA | SEQ ID No 251 |
| KYYPINMDFKPNFITTYKCECVAPDTVNTTVFNASAPLAPDTNA | SEQ ID No 252 |
| CIRRSCLHRRRTFTYQSGSGEETILQFSSGTLTLTRRPKLQPEP | SEQ ID No 253 |
| MTNPSDRVLPANSMAESREGDFGCTVMELRKLMELRSRDALTQIN | SEQ ID No 254 |
| WLHRRLPPQPIRPLPRFAPLVKTEPQRPVKEEEPKIPGDLDQEPS | SEQ ID No 255 |
| WCQCCPHTCCCYVRCPCCPDKCCCPEALYAAGKAATSGVPSIYAP | SEQ ID No 256 |
| AVCQCRRKNYGQLDIFPARDTYHPMSEYPTYHTHGRYVPPSSTDR | SEQ ID No 257 |
| TVVLRVQFPSWNGLGSIPSTDIYKSTKNYKNIEEPQGVKILRFSSP | SEQ ID No 258 |
| DNTVPGSPEERGLIQWKAGAHANSDMSSSLKSYDFPIGMGIVKRITF | SEQ ID No 259 |
| YRCSQHSSSSEESTKRTSHSKLPEQEAAEADLSNMERVSLSTADPQG | SEQ ID No 260 |

TABLE 3-continued

Examples of naturally occurring N-terminal flanking regions of ITIM only intracellular domains varying in length from 0 to 4211 (Table 3 comprises SEQ ID No 42 to SEQ ID No 351)

| Sequence | ID |
|---|---|
| GLKGIRSALKRPVEQPLGEIPEKSLHSIAVSSIQKAKGYQLLEEEKIV | SEQ ID No 261 |
| RWRRRKGQQRTKATTPAREPFQNTEEPYENIRNEGQNTDPKLNPKDDG | SEQ ID No 262 |
| RFTGHPGAYLRLINRWRLEECHPSGCLIDLCMQMGIIMVLKQTWNNFME | SEQ ID No 263 |
| VVALIYCRKKRISALPGYPECREMGETLPEKPANPTNPDEADKVGAENT | SEQ ID No 264 |
| SYRYVTKPPAPPNSLNVQRVLTFQPLRFIQEHVLIPVFDLSGPSSLAQP | SEQ ID No 265 |
| SNKCDVVVVGGGISGMAAAKLLHDSGLNVVVLEARDRVGGRTYTLRNQK | SEQ ID No 266 |
| TLRNATQQKDMVEVADFDFSPMSDKNPEPPSGVRCCCQMCCGPFLLETP | SEQ ID No 267 |
| HRQNQIKQGPPRSKDEEQKPQQRPDLAVDVLERTADKATVNGLPEKDRETDTSALAAGSSQE | SEQ ID No 268 |
| MDEEEDGAGAEESGQPRSFMRLNDLSGAGGRPGPGSAEKDPGSADSEAEG | SEQ ID No 269 |
| EMLHLGFGTIRDSLNSKRRELEDPGAYNYPFTWNTPSAPPGYNIAVKPDQ | SEQ ID No 270 |
| AKTGRTSIQRDLKEQQPQALAPGRGPSHSSAFSMSPLSTAQAPLPNPRTAA | SEQ ID No 271 |
| LCLRKQSNGREAEYSDKHGQYLIGHGTKVYIDPFTYEDPNEAVREFAKEID | SEQ ID No 272 |
| KNFRRDFFILLSKCGCYEMQAQIYRTETSSTVHNTHPRNGHCSSAPRVTNG | SEQ ID No 273 |
| QDIGYFLKVAAVGRRVRSYGKRRPARTILRAFLEKARQTPHKPFLLFRDET | SEQ ID No 274 |
| MSAARPQFSIDDAFELSLEDGGPGPESSGVARFGPLHFERRARFEVADEDKQSR | SEQ ID No 275 |
| YAATSRQLKRLESVSRSPIYSHFSETVTGASVIRAYNRSRDFEIISDTKVDANQR | SEQ ID No 276 |
| MTVPKEMPEKWARAQAPPSWSRKKPSWGTEEERRARANDREYNEKFQYASNCIKT | SEQ ID No 277 |
| KTHRRKAARTAVGRNDTHPTTGSASPKHQKKSKLHGPTETSSCSGAAPTVEMDEE | SEQ ID No 278 |
| KARRKQAAGRPEKMDDEDPIMGTITSGSRKKPWPDSPGDQASPPGDAPPLEEQKE | SEQ ID No 279 |
| RVKTRRKKAAQPVQNTDDVNPVMVSGSRGHQHQFQTGIVSDHPAEAGPISEDEQE | SEQ ID No 280 |
| MKFEEKCGDNGSIVGRNQSYPGEKHQPKGKPIANGEAEVYAKQEANGKCSTPRKSL | SEQ ID No 281 |
| DIKINQYIIKKCSPCCACLAKAMERSEQQPLMGWEDEGQPFIRRQSRTDSGIFYED | SEQ ID No 282 |
| MAEPQAESEPLLGGARGGGGDWPAGLTTYRSIQVGPGAAARWDLCIDQAVVFIEDA | SEQ ID No 283 |
| AVTISLAYSVKKMMKDNNLVRHLDACETMGNATAICSDKTGTLTTNRMTVVQAYVGD | SEQ ID No 284 |
| AVTISLAYSVKKMMKDNNLVRHLDACETMGNATAICSDKTGTLTMNRMTVVQAYIGG | SEQ ID No 285 |
| SNMKSRSAGKLWELQHEIEVYRKTVIAQWRALDLDVVLTPMLAPALDLNAPGRATGA | SEQ ID No 286 |
| HPELNVQKRKRSFKAVVTAATMSSRLSHKPSDRPNGEAKTELCENVDPNSPAAKKKY | SEQ ID No 287 |
| RKSNFIFDKLHKVGIKTRRQWRRSQFCDINILAMFCNENRDHIKSLNRLDFITNESD | SEQ ID No 288 |

TABLE 3-continued

Examples of naturally occurring N-terminal flanking regions of ITIM only intracellular domains varying in length from 0 to 4211 (Table 3 comprises SEQ ID No 42 to SEQ ID No 351)

| | |
|---|---|
| KICRKEARKRAAAEQDVPSTLGPISQGHQHECSAGSSQDHPPPGAATY TPGKGEEQE | SEQ ID No 289 |
| SGKTLESWRSLCTRCCWASKGAAVGGGAGATAAGGGGGPGGGGGG GPGGGGGPGGGGG | SEQ ID No 290 |
| RSCRKKSARPAADVGDIGMKDANTIRGSASQGNLTESWADDNPRHHGL AAHSSGEERE | SEQ ID No 291 |
| MKSKMRQALGFAKEARESPDTQALLTCAEKEEENQENLDWVPLTTLSH CKSLRTMTAI | SEQ ID No 292 |
| AILFAVVARGTTILAKHAWCGGNFLEVTEQILAKIPSENNKLTYSHGNYLF HYICQDR | SEQ ID No 293 |
| MDHAEENEILAATQRYYVERPIFSHPVLQERLHTKDKVPDSIADKLKQAF TCTPKKIRN | SEQ ID No 294 |
| KKLVKKFRQKKQRQWIGPTGMNQNMSFHRNHTATVRSHAENPTASHV DNEYSQPPRNSHL | SEQ ID No 295 |
| MPRRLQPRGAGTKGPPAPAPAASGAARNSHSAASRDPPASAKPLLRW DEVPDDFVECFIL | SEQ ID No 296 |
| RSCRKKSARPAVGVGDTGMEDANAVRGSASQGPLIESPADDSPPHHAP PALATPSPEEGE | SEQ ID No 297 |
| DNFEYLTRDSSILGPHHLDEFIRVWAEYDPAACGRISYNDMFEMLKHMS PPLGLGKKCPAR | SEQ ID No 298 |
| SKRWTHLPCGCIINCRQNAYAVASDGKKIKRKGFEFNLSFQKSYGIYKIA HEDYYDDDENS | SEQ ID No 299 |
| NFNYFYHRETEGEEQSQYMHVGSCQHLSSSAEELRKARSNSTLSK | SEQ ID No 300 |
| VRSCRKKSARPAAGVGDTGIEDANAVRGSASQGPLTEPWAEDSPPDQP PPASARSSVGEGE | SEQ ID No 301 |
| LKLANEETIKNITHWTLFNYYNSSGWNESVPRPPLHPADVPRGSCWETA VGIEFMRLTVSDML | SEQ ID No 302 |
| MCHSRSCHPTMTILQAPTPAPSTIPGPRRGSGPEIFTFDPLPEPAAAPAG RPSASRGHRKRSRR | SEQ ID No 303 |
| ASSAASSEHFEKLHEIFRGLHEDLQGVPERLLGTAGTEEKKKLIRDFDEK QQEANETLAEMEEE | SEQ ID No 304 |
| MADQIPLYPVRSAAAAAANRKRAAYYSAAGPRPGADRHSRYQLEDESA HLDEMPLMMSEEGFENEE | SEQ ID No 305 |
| SMILSASVIRVRDGLPLSASTDYEQSTGMQECRKYFKMLSRKLAQLPDR CTLKTGHYNINFISSLG | SEQ ID No 306 |
| LTRKKKALRIHSVEGDLRRKSAGQEEWSPSAPSPPGSCVQAEAAPAGL CGEQRGEDCAELHDYFNV | SEQ ID No 307 |
| TIPTSRLKFLKEAGRLTQKEEIPEEELNEDVEEIDHAERELRRGQILWFRG LNRIQTQIRVVKAFRS | SEQ ID No 308 |
| TIPTSQLKCLKEAGHGPGKDEMTDEELAEGEEEIDHAERELRRGQILWF RGLNRIQTQIRVVKAFRS | SEQ ID No 309 |
| KCYFLRKAKAKQMPVEMSRPAVPLLNSNNEKMSDPNMEANSHYGHND DVRNHAMKPINDNKEPLNSD | SEQ ID No 310 |
| MGDTHWRVAQERDELWRAQVVATTVMLERKLPRCLWPRSGICGCEFG LGDRWFLRVENHNDQNPLRV | SEQ ID No 311 |
| YSPGDYICKKGDIGREMYIIKEGKLAVVADDGVTQFVVLSDGSYFGEISIL NIKGSKAGNRRTANIKS | SEQ ID No 312 |
| FSPGDYICRKGDIGKEMYIIKEGKLAVVADDGVTQYALLSAGSCFGEISIL NIKGSKMGNRRTANIRS | SEQ ID No 313 |
| CLKIIKEYERAVVFRLGRIQADKAKGPGLILVLPCIDVFVKVDLRTVTCNIP PQEILTRDSVTTQVDG | SEQ ID No 314 |

TABLE 3-continued

Examples of naturally occurring N-terminal flanking regions of ITIM only intracellular domains varying in length from 0 to 4211 (Table 3 comprises SEQ ID No 42 to SEQ ID No 351)

| Sequence | SEQ ID |
|---|---|
| MTEGARAADEVRVPLGAPPPGPAALVGASPESPGAPGREAERGSELGVSPSESPAAERGAELGADEEQR | SEQ ID No 315 |
| VRLRLQKHRPPADPCRGETETMNNLANCQREKDISVSIIGATQIKNTNKKADFHGDHSADKNGFKARYPA | SEQ ID No 316 |
| VITTCLALGTRRMAKKNAIVRSLPSVETLGCTSVICSDKTGTLTTNQMSVCRMFILDRVEGDTCSLNEFTITG | SEQ ID No 317 |
| MEAVLNELVSVEDLLKFEKKFQSEKAAGSVSKSTQFEYAWCLVRSKYNDDIRKGIVLLEELLPKGSKEEQRDY | SEQ ID No 318 |
| TRPKPLKPPCDLSMQSVEVAGSGGARRSALLDSDEPLVYFYDDVTTLYEGFQRGIQVSNNGPCLGSRKPDQPYEW | SEQ ID No 319 |
| HRPKALQPPCNLLMQSEEVEDSGGARRSVIGSGPQLLTHYYDDARTMYQVFRRGLSISGNGPCLGFRKPKQPYQW | SEQ ID No 320 |
| RRHQGKQNELSDTAGREINLVDAHLKSEQTEASTRQNSQVLLSETGIYDNDPDLCFRMQEGSEVYSNPCLEENKPG | SEQ ID No 321 |
| WSCERYRADVRTVWEQCVAIMSEEDGDDDGGCDDYAEGRVCKVRFDANGATGPGSRDPAQVKLLPGRHMLFPPLER | SEQ ID No 322 |
| GPLVRYLDVKKTNKKESINEELHIRLMDHLKAGIEDVCGHWSHYQVRDKFKKFDHRYLRKILIRKNLPKSSIV | SEQ ID No 323 |
| KYPTLLHQRKKQRFLSKHISHRGGAGENLENTMAAFQHAVKIGTDMLELDCHITKDEQVVVSHDENLKRATGVNVNISD | SEQ ID No 324 |
| AHDHYTVDVVVAYYITTRLFWWYHTMANQQVLKEASQMNLLARVWWYRPFQYFEKNVQGIVPRSYHWPFPWPVVHLSRQ | SEQ ID No 325 |
| SKASRAPRAHRDINVPRALVDILRHQAGPGTRPDRARSSSLTPGIGGPDSMPPRTPKNLYNTVKTPNLDWRALPPPSPS | SEQ ID No 326 |
| FKVYKWKQSRDLYRAPVSSLYRTPGPSLHADAVRGGLMSPHLYHQVYLTTDSRRSDPLLKKPGAASPLASRQNTLRSCDP | SEQ ID No 327 |
| MLCRKTSQQEHVYEAARAHAREANDSGETMRVAIFASGCSSDEPTSQNLGNNYSDEPCIGQEYQIIAQINGNYARLLDTVP | SEQ ID No 328 |
| KQKNEHHHGHSHYASESLPSKKDQEEGVMEKLQNGDLDHMIPQHCSSELDGKAPMVDEKVIVGSLSVQDLQASQSACYWLKG | SEQ ID No 329 |
| HKALMERALRATFREALSSLHSRRRLDTEKKHQEHLLLSILPAYLAREMKAEIMARLQAGQGSRPESTNNFHSLYVKRHQGVS | SEQ ID No 330 |
| HKHQMQDASRDLFTYTVKCIQIRRKLRIEKRQQENLLLSVLPAHISMGMKLAIIERLKEHGDRRCMPDNNFHSLYVKRHQNVS | SEQ ID No 331 |
| ERFVAKPCAIALNIQANGPQIAPPNAILEKVFTAITKHPDEKRLEGLSKQLDWDVRSIQRWFRQRRNQEKPSTLTRFCESMWRF | SEQ ID No 332 |
| AWRLWRCRVARSRELNKPWAAQDGPKPGLGLQPRYGSRSAPKPQVAVPSCPSTPDYENMFVGQPAAEHQWDEQGAHPSEDNDFY | SEQ ID No 333 |
| HLSQWTRGRSRSHPGQGRSGESVEEVPLYGNLHYLQTGRLSQDPEPDQQDPTLGGPARAAEEVMCYTSLQLRPPQGRIPGPGTP | SEQ ID No 334 |
| KKRHCGYSKAFQDSDEEKMHYQNGQAPPPVFLPLHHPPGKLPEPQFYAEPHTYEEPGRAGRSFTREIEASRIHIEKIIGSGDSGE | SEQ ID No 335 |
| QSVFNKRKSRVRHYLVKCPQNSSGETVTSVTSLAPLQPKKGKRQKEKPDIPPAVPAKAPIAPTFHKPKLLKPQRKVTLPKIAEEN | SEQ ID No 336 |
| MASPGAGRAPPELPERNCGYREVEYWDQRYQGAADSAPYDWFGDFSSFRALLEPELRPEDRILVLGCGNSALSYELFLGGFPNVTS | SEQ ID No 337 |
| MPHFTVVPVDGPRRGDYDNLEGLSWVDYGERAELDDSDGHGNHRESSPFLSPLEASRGIDYYDRNLALFEEELDIRPKVSSLLGKL | SEQ ID No 338 |
| AIPTRSLKFLKEAGHGTTKEEITKDAEGLDEIDHAEMELRRGQILWFRGLNRIQTQIDVINTFQTGASFKGVLRRQNMGQHLDVKLVPS | SEQ ID No 339 |

TABLE 3-continued

Examples of naturally occurring N-terminal flanking regions of ITIM only intracellular domains varying in length from 0 to 4211 (Table 3 comprises SEQ ID No 42 to SEQ ID No 351)

| Sequence | SEQ ID |
|---|---|
| IFMKTAQAHRRAETLIFSKHAVIALRHGRLCFMLRVGDLRKSMIISATIHM QVVRKTTSPEGEVVPLHQVDIPMENGVGGNSIFLVAPL | SEQ ID No 340 |
| SWKRYPASMKQLQQRSLMRRHRKKKRQSLKQMTPSTQEFYVDYKPTN TETSEMLLNGTGPCTYNKSGSRECEIPLSMNVSTFLAYDQPT | SEQ ID No 341 |
| MANVSKKVSWSGRDRDDEEAAPLLRRTARPGGGTPLLNGAGPGAARQ SPRSALFRVGHMSSVELDDELLDPDMDPPHPFPKEIPHNEKLLS | SEQ ID No 342 |
| RLFKRRQGRIFPEGSCLNTFTKNPYAASKKTIYTYIMASRNTQPAESRIYD EILQSKVLPSKEEPVNTVYSEVQFADKMGKASTQDSKPPGT | SEQ ID No 343 |
| AMCLWKNRQQNTIQKYDPPGYLYQGSDMNGQMVDYTTLSGASQINGN VHGGFLTNGGLS | SEQ ID No 344 |
| LGSGFALKVQEQHRQKHFEKRRMPAANLIQAAWRLYSTDMSRAYLTAT WYYYDSILPSFRELALLFEHVQRARNGGLRPLEVRRAPVPDGAP | SEQ ID No 345 |
| MSSHKGSVVAQGNGAPASNREADTVELAELGPLLEEKGKRVIANPPKAE EEQTCPVPQEEEEEVRVLTLPLQAHHAMEKMEEFVYKVWEGRWRV | SEQ ID No 346 |
| WRMMKYQQKAAGMSPEQVLQPLEGDLCYADLTLQLAGTSPQKATTKLS SAQVDQVEVEYVTMASLPKED | SEQ ID No 347 |
| HYARARRKPGGLSATGTSSHSPSECQEPSSSRPSRIDPQEPTHSKPLAP MELEPMYSNVNPGDSNPIYSQIWSIQHTKENSANCPMMHQEHEELT | SEQ ID No 348 |
| MAKRKQGNRLGVCGRFLSSRVSGMNPSSVVHHVSDSGPAAELPLDVP HIRLDSPPSFDNTTYTSLPLDSPSGKPSLPAPSSLPPLPPKVLVCSKP | SEQ ID No 349 |
| SPNRKNPLWPSVPDPAHSSLGSWVPTIMEEDAFQLPGLGTPPITKLTVL EEDEKKPVPWESHNSSETCGLPTLVQTYVLQGDPRAVSTQPQSQSGTS DQ | SEQ ID No 350 |
| KRVQETKFGNAFTEEDSELVVNYIAKKSFCRRAIELTLHSLGVSEELQNK LEDVVIDRNLLILGKILGEGEFGSVMEGNLKQEDGTSLKVAVKTMKLDNS SQREIEEFLSEAACMKDFSHPNVIRLLGVCIEMSSQGIPKPMVILPFMKY GDLHTY | SEQ ID No 351 |

TABLE 4

Examples of naturally occurring C-terminal flanking regions of ITIM only intracellular domains (Table 4 comprises SEQ ID No 352 to SEQ ID No 685)

K

I

N

R

E

S

R

G

Q

I

A

YA

VQ

QE

TABLE 4-continued

Examples of naturally occurring C-terminal flanking regions of ITIM only intracellular domains (Table 4 comprises SEQ ID No 352 to SEQ ID No 685)

| | |
|---|---|
| MT | |
| SK | |
| AR | |
| AK | |
| RR | |
| QI | |
| QI | |
| LT | |
| VI | |
| VLT | |
| KVS | |
| ARS | |
| IFR | |
| TFL | |
| QGVQ | SEQ ID No 352 |
| FSVR | SEQ ID No 353 |
| YSSK | SEQ ID No 354 |
| PKTR | SEQ ID No 355 |
| VNDT | SEQ ID No 356 |
| GMQQ | SEQ ID No 357 |
| PDLL | SEQ ID No 358 |
| HKSL | SEQ ID No 359 |
| RQPLN | SEQ ID No 360 |
| RTPTN | SEQ ID No 361 |
| RNLTN | SEQ ID No 362 |
| TVFSP | SEQ ID No 363 |
| NRFMK | SEQ ID No 364 |
| LNAIA | SEQ ID No 365 |
| LFTML | SEQ ID No 366 |
| MYVMG | SEQ ID No 367 |
| VTGTR | SEQ ID No 368 |
| TTHRR | SEQ ID No 369 |
| VTRRK | SEQ ID No 370 |
| VTPVR | SEQ ID No 371 |
| MTVRK | SEQ ID No 372 |
| MTVKR | SEQ ID No 373 |
| VTPRR | SEQ ID No 374 |
| KPWWD | SEQ ID No 375 |

TABLE 4-continued

Examples of naturally occurring C-terminal flanking regions of ITIM only intracellular domains (Table 4 comprises SEQ ID No 352 to SEQ ID No 685)

| Sequence | SEQ ID |
|---|---|
| NRLMK | SEQ ID No 376 |
| FKETV | SEQ ID No 377 |
| PFLKNT | SEQ ID No 378 |
| VTQRRG | SEQ ID No 379 |
| MTERKA | SEQ ID No 380 |
| VTMRRT | SEQ ID No 381 |
| RQALAE | SEQ ID No 382 |
| APDSNT | SEQ ID No 383 |
| SKKRGG | SEQ ID No 384 |
| EISAAS | SEQ ID No 385 |
| STLGPG | SEQ ID No 386 |
| NSLSFL | SEQ ID No 387 |
| AHLVQY | SEQ ID No 388 |
| DEHDAII | SEQ ID No 389 |
| VTKRCAR | SEQ ID No 390 |
| KRIEHAK | SEQ ID No 391 |
| VTPWRLR | SEQ ID No 392 |
| VTPCRLR | SEQ ID No 393 |
| RWGFSKQ | SEQ ID No 394 |
| RGDDKDC | SEQ ID No 395 |
| ATRMMMG | SEQ ID No 396 |
| GPSRDPD | SEQ ID No 397 |
| VTLPRARR | SEQ ID No 398 |
| RLPYQLAQ | SEQ ID No 399 |
| LGSFLIGS | SEQ ID No 400 |
| MGDDSSNS | SEQ ID No 401 |
| PLSHLAQN | SEQ ID No 402 |
| ATEGKSVC | SEQ ID No 403 |
| HNNCEKDSV | SEQ ID No 404 |
| RTMKPLPRH | SEQ ID No 405 |
| SQRRNPWQA | SEQ ID No 406 |
| YPMKITGNR | SEQ ID No 407 |
| VSHLRSPRK | SEQ ID No 408 |
| SYPARTRKV | SEQ ID No 409 |
| WGRLRFARK | SEQ ID No 410 |
| VFLNKVMRG | SEQ ID No 411 |
| SGSGYQLV | SEQ ID No 412 |
| HSDSLGSAS | SEQ ID No 413 |

TABLE 4-continued

Examples of naturally occurring C-terminal flanking regions of ITIM only intracellular domains (Table 4 comprises SEQ ID No 352 to SEQ ID No 685)

| | |
|---|---|
| KATVHLAYL | SEQ ID No 414 |
| CAEDYHWQWR | SEQ ID No 415 |
| QRLLVKAKTQ | SEQ ID No 416 |
| EDFLEESRNQ | SEQ ID No 417 |
| GEKAFGWPGK | SEQ ID No 418 |
| PTVSPFLRQR | SEQ ID No 419 |
| PRTVLWLTIE | SEQ ID No 420 |
| EVCWKLPQSK | SEQ ID No 421 |
| ISNRWLSIGV | SEQ ID No 422 |
| GNCSFFTETG | SEQ ID No 423 |
| DSIRGYFGET | SEQ ID No 424 |
| LHSNSFIRNNY | SEQ ID No 425 |
| TYYSETTVTRT | SEQ ID No 426 |
| TYYSRRTLLGV | SEQ ID No 427 |
| SSYFLGKLLSD | SEQ ID No 428 |
| QARLRQHYQTI | SEQ ID No 429 |
| LVFHHMAQHLMM | SEQ ID No 430 |
| YSTKITIPVIKR | SEQ ID No 431 |
| TYHSERTVTFTY | SEQ ID No 432 |
| PGSNYSEGWHIS | SEQ ID No 433 |
| LCANKKSSVKIT | SEQ ID No 434 |
| DGSPDYQKAKLQ | SEQ ID No 435 |
| VRRQLPVEEPNP | SEQ ID No 436 |
| KLNQVVRKVSAL | SEQ ID No 437 |
| ILRDYKQSSSTL | SEQ ID No 438 |
| DPAKYARWKPWLK | SEQ ID No 439 |
| QLRFNKPVRYAAT | SEQ ID No 440 |
| ELRFNKCVRLCGT | SEQ ID No 441 |
| GLKDQVNTVGIPI | SEQ ID No 442 |
| YKTSQNALDFNTKV | SEQ ID No 443 |
| PSENKENSAVPVEE | SEQ ID No 444 |
| ARTKISDDDDEHTL | SEQ ID No 445 |
| PITKWLPAYKFKEY | SEQ ID No 446 |
| SNLDEVGQQVERLD | SEQ ID No 447 |
| RATASLNANEVEWF | SEQ ID No 448 |
| EMRFSRAVRLCGTLQ | SEQ ID No 449 |
| RICSLTASEGPQQKI | SEQ ID No 450 |
| PLSPYGDIIEK | SEQ ID No 451 |

TABLE 4-continued

Examples of naturally occurring C-terminal flanking regions of ITIM only intracellular domains (Table 4 comprises SEQ ID No 352 to SEQ ID No 685)

| Sequence | SEQ ID |
|---|---|
| TSESKENCTGVQVAE | SEQ ID No 452 |
| SQMNPRSPPATMCSP | SEQ ID No 453 |
| MHPDALEEPDDQNRI | SEQ ID No 454 |
| LSRMQHQSQECKSEE | SEQ ID No 455 |
| QEPNESDLPYHEMETL | SEQ ID No 456 |
| SRENSSSQDPQTEGTR | SEQ ID No 457 |
| EPSGHEKEGFMEAEQC | SEQ ID No 458 |
| KGSNYHLSDNDASDVE | SEQ ID No 459 |
| HTQSAEPPPPPEPARI | SEQ ID No 460 |
| CLISEERNECVIATEV | SEQ ID No 461 |
| ASWATNLKSSIRKANK | SEQ ID No 462 |
| TSMQPTEAMGEEPSRAE | SEQ ID No 463 |
| LSQEHRLLRHSSMADKK | SEQ ID No 464 |
| YSQKPPKRASSQLSWFS | SEQ ID No 465 |
| PRRPGEPREVHIGRALGR | SEQ ID No 466 |
| DTLSTRPGYLWVVWIYRN | SEQ ID No 467 |
| SIMNADILNYCQKESWCK | SEQ ID No 468 |
| NRGPPLDRAEVYSSKLQD | SEQ ID No 469 |
| ISKLSHSKGHQKRKALKTT | SEQ ID No 470 |
| DQNVNEAMPSLKITNDYIF | SEQ ID No 471 |
| DNSPLRRKSIYLVIIV | SEQ ID No 472 |
| QGQRSDVYSDLNTQRPYYK | SEQ ID No 473 |
| EIYLEPLKDAGDGVRYLLR | SEQ ID No 474 |
| LKHDTNIYCRMDHKAEVAS | SEQ ID No 475 |
| QWPALKEKYPKSVYLGRIV | SEQ ID No 476 |
| GKIFSSCFHNTILCMQKESE | SEQ ID No 477 |
| LDDHDYGSWGNYNNPLYDDS | SEQ ID No 478 |
| VRENHGLLPPLYKSVKTYTV | SEQ ID No 479 |
| PCTAQECLASVLKPTNETLN | SEQ ID No 480 |
| PNCNKPRWEKWFMVTFASST | SEQ ID No 481 |
| GYKAFGLVGKLAASGSITMQN | SEQ ID No 482 |
| FGRTVAIKPPKCWTGRFLMNL | SEQ ID No 483 |
| FRRTVSSKTPKCPTGRLLMNL | SEQ ID No 484 |
| NFHGMNPSKDTSTEYSEVRTQ | SEQ ID No 485 |
| HNPTLQVFRKTALLGANGAQP | SEQ ID No 486 |
| GELSLASLHIPFVETQHQTQV | SEQ ID No 487 |
| GEEGVALPANGAGGPGGASARK | SEQ ID No 488 |
| DRRSNQVARALHDHLGLRQGDC | SEQ ID No 489 |

TABLE 4-continued

Examples of naturally occurring C-terminal flanking regions of ITIM only intracellular domains (Table 4 comprises SEQ ID No 352 to SEQ ID No 685)

| Sequence | SEQ ID |
|---|---|
| NHRVDASSMWLYRRYYSNVCQR | SEQ ID No 490 |
| QKMDSLDAMEGDVELEWEETTM | SEQ ID No 491 |
| FHTLRGKGQAAEPPDFNPRDSYS | SEQ ID No 492 |
| SVYQYGSALAHFFYSSDQAWYDR | SEQ ID No 493 |
| DSAEAPADPFAVPEGRSQDARGY | SEQ ID No 494 |
| SAGNGGSSLSYTNPAVAATSANL | SEQ ID No 495 |
| KAKLQSSPDYLQVLEEQTALNKI | SEQ ID No 496 |
| LLKGLGRRQACGYCVFWLLNPLPM | SEQ ID No 497 |
| SRGLQGTYQDVGSLNIGDVQLEKP | SEQ ID No 498 |
| APVVFFYLSQDSRPRSWCLRTVCN | SEQ ID No 499 |
| HFHKVQPQEPKVTDTEYSEIKIHK | SEQ ID No 500 |
| SISLHGLSQVSEDPPSVFNMPEAD | SEQ ID No 501 |
| VNNCEHFVTLLRYGEGVSEQANRA | SEQ ID No 502 |
| QNWGPRFKKLADLYGSKDTFDDDS | SEQ ID No 503 |
| KLRSDCSRPSLQWYTRAQSKMRRPS | SEQ ID No 504 |
| DHSRSTKAVSEKKAKGLGESRKDKK | SEQ ID No 505 |
| STGLTWRSGTASSVSYPKQMPLSQV | SEQ ID No 506 |
| AATVFFCLGQTTRPRSWCLRLVCNP | SEQ ID No 507 |
| YAANPVITPEPVTSPPSYSSEIQANK | SEQ ID No 508 |
| NHCVFTQRKITRPSQRPKTPPTDTSV | SEQ ID No 509 |
| TQGAKEHEEAESGEGTRRRAAEAPSM | SEQ ID No 510 |
| DHLALSRPRRLSTADPADASTIYAVVV | SEQ ID No 511 |
| STSALSEAASDTTQEPPGSHEYAALKV | SEQ ID No 512 |
| SFHKGEPQDLSGQEATNNEYSEIKIPK | SEQ ID No 513 |
| EGALHRSSMQPDNSSDSDYDLHGAQRL | SEQ ID No 514 |
| SFHKARPQYPQEQEAIGYEYSEINIPK | SEQ ID No 515 |
| SFQMVKPWDSRGQEATDTEYSEIKIHR | SEQ ID No 516 |
| IFPGGNKGGGTSCGPAQNPPNNQTPSS | SEQ ID No 517 |
| ELPTATQAQNDYGPQQKSSSSRPSCSCL | SEQ ID No 518 |
| KVPAEEPANELPMNEIEAWKAAEKKARW | SEQ ID No 519 |
| SHQWKSSEDNSKTFSASHNVEATSMFQL | SEQ ID No 520 |
| KEEEMADTSYGTVKAENIIMMETAQTSL | SEQ ID No 521 |
| NLTALDWSLLSKKECLSYGGRLLGNSCK | SEQ ID No 522 |
| SFSEMKSREPKDQEAPSTTEYSEIKTSK | SEQ ID No 523 |
| ELIKPHRAAKGAPTSTVYAQILFEENKL | SEQ ID No 524 |
| NHSVIGPNSRLARNVKEAPTEYASICVRS | SEQ ID No 525 |
| DLASQPVYCNLQSLGQAPMDEEEYVIPGH | SEQ ID No 526 |
| DYDNSENQLFLEEERRINHTAFRTVEIKR | SEQ ID No 527 |

TABLE 4-continued

Examples of naturally occurring C-terminal flanking regions of ITIM only intracellular domains (Table 4 comprises SEQ ID No 352 to SEQ ID No 685)

| Sequence | SEQ ID |
|---|---|
| DHSGGHHSDKINKSESVVYADIRKN | SEQ ID No 528 |
| DHWALTQRTARAVSPQSTKPMAESITYAAVARH | SEQ ID No 529 |
| ENLIYENVAAIQAHKLEV | SEQ ID No 530 |
| SETTGLTPDQVKRNLEKYGLNELPAEEGKT | SEQ ID No 531 |
| SLCYKFLSYFRASSTMRY | SEQ ID No 532 |
| KLEKLVSSLREEDEYSIHPPSSRWKRFYRA | SEQ ID No 533 |
| SHLRKIRTCTSIMEKDLTYSSVKRHL | SEQ ID No 534 |
| ALSSSTSPRAPPSHRPLKSPQNETLYSVLKA | SEQ ID No 535 |
| DPENQNFLLESNLGKKKYETEFHPGTTSFGMS | SEQ ID No 536 |
| FTYGVRFLKKTPWLWNTRHCWYNYPYQPLTTD | SEQ ID No 537 |
| KTLRSLEATDSAFDNPDYWHSRLFPKANAQRT | SEQ ID No 538 |
| QFQNSSEMEKIPEIGKFGEKAPPAPSHVWRPAA | SEQ ID No 539 |
| TFQDSAGARNNRDGNNLRKRGHPAPSPIWRHAA | SEQ ID No 540 |
| LALSSGSRKASAVGDVVNLVSVDVQRLTESVLY | SEQ ID No 541 |
| DILRPYFDVEPAQVRSRLLESMIPIKMVNFPQK | SEQ ID No 542 |
| TCQFEGLLRPYIQHAMYDEEKGTPIFICPVSWG | SEQ ID No 543 |
| LQLDKVDVIPVTAINLYPDGPEKRAENLEDKTCI | SEQ ID No 544 |
| CPVFKGFSSSSKDQIAIPEDTPENTETASVCTKV | SEQ ID No 545 |
| NFEAQQPTQPTSASPSLTATEIIYSEVKKQ | SEQ ID No 546 |
| WSMQQPESSANIRTLLENKDSQVIYSSVKKS | SEQ ID No 547 |
| GRQPGKREPLRSVLRRALGEGAELGARGQSLPMGLL | SEQ ID No 548 |
| PDWLKDNDYLLHGHRPPMPSFRACFKSIFRIHTETG | SEQ ID No 549 |
| DGSHIHTFLDVSFSEALYPVFRILTLEPTALTICPA | SEQ ID No 550 |
| DHWALTQRTARAVSPQSTKPMAESITYAAVARH | SEQ ID No 551 |
| HSLTLRREATEPPPSQEREPPAEPSIYAPLAIH | SEQ ID No 552 |
| RFKNEFKSSGINTASSAASKERTAPHKSNTGFPKLLCA | SEQ ID No 553 |
| REKMWHGRQRLGGVGAGSRPPMPAHPTPASIFSARSTDV | SEQ ID No 554 |
| KKTHPDDSAGEASSRGRAHEEDDEENYENVPRVLLASDH | SEQ ID No 555 |
| GSAQGRRLPLRLVLQRALGDEAELGAVRETSRRGLVDIAA | SEQ ID No 556 |
| SSPTSPTSPGPQQAPPRETYLSEKIPIPDTKPGTFSLRKL | SEQ ID No 557 |
| AGFPKTRLGRLATSTSRSRQLSLCDDYEEQTDEYFFDRDP | SEQ ID No 558 |
| KSLMARRTYLEWPKEKSKRGLFWANLRAAINIKLTEQAKK | SEQ ID No 559 |
| LPWEPSLESEEEVEEEETSEALVLNPRRHQDSSRNKAGGLP | SEQ ID No 560 |
| KESDHFSTELDDITVTDTYLSATKVSFDDTCLASEVSFSQS | SEQ ID No 561 |
| QNLCSRLKTSPVEGLSGNPADLEKRRQVFGHNVIPPKKPKT | SEQ ID No 562 |
| NHCVFTQRKITRPSQRPKTPPTDIIVYTELPNAEP | SEQ ID No 563 |
| TMKTSDKFKFVFREKMGRIVDYFTIQNPSNVDH | SEQ ID No 564 |
| SENFRKAYKQVFKCHIRKDSHLSDTKESKSRIDTPPSTNCTHV | SEQ ID No 565 |

TABLE 4-continued

Examples of naturally occurring C-terminal flanking regions of ITIM only intracellular domains (Table 4 comprises SEQ ID No 352 to SEQ ID No 685)

| Sequence | ID |
|---|---|
| EFMNEQKLNRYPASSLVVVRSKTEDHEEAGPLPTKVNLAHSEI | SEQ ID No 566 |
| GNYRLKEYEKALKYVRGLLQTEPQNNQAKELERLIDKAMKKDG | SEQ ID No 567 |
| PAGEEDEEEEEDLGWGCPDVAGPTRPTAPPDLHNYMRRIKEIA | SEQ ID No 568 |
| SGLREQTIAIKCLVVLVVALGLPFLAIGYWIAPCSRLGKILRS | SEQ ID No 569 |
| SGLRQQTMAVKFLVVLAVAIGLPFLALIYWFAPCSKMGKIMRG | SEQ ID No 570 |
| SGLRQQTMAVKFLVVLAVAIGLPFLALIYWFAPCSKMGKIMRG | SEQ ID No 571 |
| PPVSRAYTTACVLTTAAVQLELITPFQLYFNPELIFKHFQIWRL | SEQ ID No 572 |
| GNVLILRSVSTAVYKRFPSAQHLVQAGFMTPAEHKQLEKLSLPH | SEQ ID No 573 |
| QNWWTRRKVRQEHGPERKISFPQWEKDYNLQPMNAYGLFDEYLE | SEQ ID No 574 |
| DSNIAFSVNASDKGEASCCDPVSAAFEGCLRRLFTRWGSFCVRNP | SEQ ID No 575 |
| QVSSAESHKDLGKKDTETVYSEVRKAVPDAVESRYSRTEGSLDGT | SEQ ID No 576 |
| VLDSEPKSQASGPEPELYASVCAQTRRARASFPDQAYANSQPAAS | SEQ ID No 577 |
| ETGINLRGALLAMIYNKILRLSTSNLSMGEMTLGQINNLVAIETNQ | SEQ ID No 578 |
| AAGRARAKACRAPGSYGRGTHCHYKAPTVVLHMTKTDPSLENPTHL | SEQ ID No 579 |
| HHELLSHKSFETNAQEDTMETHLETELDLSTITTAGRISDHKQQLA | SEQ ID No 580 |
| DQKYVLILNVFPAPPKRSFLPQVLTEWYIPLEKDERHQWIVLLSFQL | SEQ ID No 581 |
| LQTVYLGKNSEAQPARQILVLDNAAIVCNFGSELSLVYVPSVLEKLD | SEQ ID No 582 |
| RKDSEEEVSLLGSQDIEEGNHQVEDGCREMACEEFNFGEILMTQVIHS | SEQ ID No 583 |
| QRRETEVYACIENEDGSSPTAKQSPLSQERPHRFEDDGELNLVYENL | SEQ ID No 584 |
| APCAKVRPYIAEGESDTDSDLCTPCGPPPRSATGEGPFGDVGWAGPRK | SEQ ID No 585 |
| ERLGYSEDGLEELSRHSVSEADRLLSARSSVDFQAFGVKGGRRINEYFC | SEQ ID No 586 |
| RQRLCRQSVLLWPHQPSGQRSFWAQLGMALTRDNHHFYNRNFCQGPTAE | SEQ ID No 587 |
| LHRDYDRTVTLLSPPRPGRLPDLQEIGVPLYQSPPGRYLSPKKGANENV | SEQ ID No 588 |
| RSPFYDRFSEARILFLLQLLADHVPGVGLVTRPLMDYLPTWQKIYFYSWG | SEQ ID No 589 |
| NPSPDTRIELNDVVYLIRPDPLAYLPNSEPSRRNSICNVTGQDSREETQL | SEQ ID No 590 |
| RDIYAQRMHTFITSLSSVGIVVSDPDSTDASSIEDNEDICNTTSLENCTAK | SEQ ID No 591 |
| SFQGLRLWEPADQEAPSTTEYSEIKIHTGQPLRGPGFGLQLEREMSGMVPK | SEQ ID No 592 |
| LVSSVADVLAQGGGPRSSQHCGEGSQLVAADHRGGLDGWEQPGAGQPPSDT | SEQ ID No 593 |
| VVSDSGISTDYSSGDSQGAQGGLSDGPYSNPYENSLIPAAEPLPPSYVACS | SEQ ID No 594 |
| NPPPDTRLEPSDIVYLIRSDPLAHVASSSQSRKSSCSHKLSSCNPETRDETQL | SEQ ID No 595 |
| HPSCCWKPDPDQVDGARSLLSPEGYQLPQNRRMTHLAQKFFPKAKDEAASPVKG | SEQ ID No 596 |
| GKKFKRYFLQLLKYIPPKAKSHSNLSTKMSTLSYRPSDNVSSSTKKPAPCFEVE | SEQ ID No 597 |
| SDNFKKSFQNVLCLVKVSGTDDGERSDSKQDKSRLNETTETQRTLLNGDLQTSI | SEQ ID No 598 |
| SPTNNTVYASVTHSNRETEIWTPRENDTITIYSTINHSKESKPTFSRATALDNV | SEQ ID No 599 |

TABLE 4-continued

Examples of naturally occurring C-terminal flanking regions of ITIM only intracellular domains (Table 4 comprises SEQ ID No 352 to SEQ ID No 685)

| Sequence | ID |
|---|---|
| LGGAAYVNTFHNIALETSDEHREFAMAATCISDTLGISLSGLLALPLHDFL CQLS | SEQ ID No 600 |
| MQKDSSQETTSCYEKIFYGHLLKKFRQPNFARKLC | SEQ ID No 601 |
| ALATSKALVKFDPEIIGPRDIIKIIEEIGFHASLAQRNPNAHHLDHKMEIKQ WKKS | SEQ ID No 602 |
| NHCVFTQRKITRPSQRPKTPPTDIIVYTELPNAESRSKVVSCP | SEQ ID No 603 |
| DHCVFTQRKITRPSQRPKTPPTDTILYTELPNAKPRSKVVSCP | SEQ ID No 604 |
| ERKRIQYLHAKLLKKRSKQPLGEVKRRLSLYLTKIHFWLPVLKMIRKKQM DMASADKS | SEQ ID No 605 |
| SEWLESIRMKRYILHFHSAGLDTMECVLELTAEDLTQMGITLPGHQKRIL CSIQGFKD | SEQ ID No 606 |
| NADAKYPGYPPEHIIAEKRRARRRLLHKDGSCNVYFKHIFGEWGSYVVDI FTTLVDTKW | SEQ ID No 607 |
| HRTSKRSEARSAEFTVGRKDSSIICAEVRCLQPSEVSSTEVNMRSRTLQ EPLSDCEEVLC | SEQ ID No 608 |
| IKYWPHTPPSIPLQIEEYLKDPTQPILEALDKDSSPKDDVWDSVSIISFPEK EQEDVLQTL | SEQ ID No 609 |
| RREPRQALAGTFRDLRLRLWPQGGGWVQQVALKQVGRRWVASNPRE SRPSTLLTNLDRGTPG | SEQ ID No 610 |
| DFQWREKTPEPPVPCVPEQTEYATIVFPSGMGTSSPARRGSADGPRSA QPLRPEDGHCSWPL | SEQ ID No 611 |
| ENDEDGAQASPEPDGGVGTRDSSRTSIRSSQWSFSTISSSTQRSYNTC CSWTQHPLIQKNRR | SEQ ID No 612 |
| DEIYLESCCQARYHQKKEQMNEELKREAETLREREGEEFDNTCCAEKR KKLWDLLEKPNSSV | SEQ ID No 613 |
| DMRPPPTAMITLNNSVYWQEFEDTCVYECLDGKDCQSFFCCYEECKSG SWRKGRIHIDILELDS | SEQ ID No 614 |
| GTLAWMITLSDGLHNFIDGLAIGASFTVSVFQGISTSVAILCEEFPHELGD FVILLNAGMSIQQ | SEQ ID No 615 |
| GHNEVIGVCRVGPDAADPHGREHWAEMLANPRKPVEHWHQLVEEKTV TSFTKGSKGLSEKENSE | SEQ ID No 616 |
| PSLSTSNKNIYEVEPTVSVVQEGCGHNSSYIQNAYDLPRNSHIPGHYDLL PVRQSPANGPSQDKQS | SEQ ID No 617 |
| DEARLERCCLRRLRRREEEAAEARAGPTERGAQGSPARALGPRGRLQ RGRRRLRDVVDNPHSGLAGK | SEQ ID No 618 |
| DELSIDSCCRDRYFRRKELSETLDFKKDTEDQESQHESEQDFSQGPCPT VRQKLWNILEKPGSSTAAR | SEQ ID No 619 |
| KETKVKELKRAKTVLTVIKWKGEKSKYPQGRFWKQLQVAMPVKKSPRR SSSDEQGLSYSSLKNV | SEQ ID No 620 |
| LSYNHHRLEEHEAETYEDGFTGNPSSLSQIPETNSEETTVIFEQLHSFVV DDDGFIEDKYIDIHELCEEN | SEQ ID No 621 |
| DESSSSPGRQMSSSDGGPPGQSDTDSSVEESDFDTMPDIESDKNIIRTK MFLYLSDLSRKDRRIVSKKYK | SEQ ID No 622 |
| RIIQEKKKHAVASDPRHLRNKGSPIIYSEVKVASTPVSGSLFLASSAPHR | SEQ ID No 623 |
| AEDHLDGCCKRRYLQKIEEFAEMVEREEEDDALDSEGRDSEGPAEGEG RLGRCMRRLRDMVERPHSGLPGK | SEQ ID No 624 |
| EDPWIGSESDKFILLGYLDQLRKDPALLSSEAVLPDLTDELAPVFLLRWF YSASDYISDCWDSIFHNNWRE | SEQ ID No 625 |

TABLE 4-continued

Examples of naturally occurring C-terminal flanking regions of ITIM only intracellular domains (Table 4 comprises SEQ ID No 352 to SEQ ID No 685)

| Sequence | SEQ ID |
|---|---|
| MDRKWYFLCNSWLSINVGDCVLDKVFPVATEQDRKQFSHLFFMKTSAG FQDGHIWYSIFSRCARSSFTRVQR | SEQ ID No 626 |
| VPSDPSVEEMRKVVCEQKLRPNIPNRWQSCEALRVMAKIMRECWYAN GAARLTALRIKKTLSQLSQQEGIKM | SEQ ID No 627 |
| CSDFQEDIVFPFSLGWSSLVHRFLGPRNAQRVLLGLSEPIFQLPRSLAST PTAPTTPATPDNASQEELMITL | SEQ ID No 628 |
| RIPLLGDEEEGSEDEGESTHLLPENENELEKFIHSVIISKRSKNIKKKLKEE QNSVTENKTKNASHNGKMEDL | SEQ ID No 629 |
| SKIPQITLNFVDLKGDPFLASPTSDREIIAPKIKERTHNVTEKVTQVLSLGA DVLPEYKLQAPRIHRWTILHY | SEQ ID No 630 |
| DHCIFTQRKITGPSQRSKRPSTDTSVCIELPNAEPRALSPAHEHHSQALM GSSRETTALSQTQLASSNVPAAGI | SEQ ID No 631 |
| PRARIMQRKRGLEWFVCDGWKFLCTSCCGWLINICRRKKELKARTVWL GCPEKCEEKHPRNSIKNQKYNVFTFI | SEQ ID No 632 |
| SPRHYYSGYSSSPEYSSESTHKIWERFRPYKKHHREEVYMAAGHALRK KVQFAKDEDLHDILDYWKGVSAQQKL | SEQ ID No 633 |
| SPQYHSLSYSSSPEYTCRASQSIWERFRLSRRRHKEEEEFMAAGHALR KKVQFAKDEDLHDILDYWKGVSAQHKS | SEQ ID No 634 |
| MAFNAKVSDPLIGGTYMTLLNTVSNLGGNWPSTVALWLVDPLTVKECVG ASNQNCRTPDAVELCKKLGGSCVTALD | SEQ ID No 635 |
| YYPHGHSHSLGLDLNLGLGSGTFHSLGNALVHGGELEMGHGGTHGFG YGVGHGLSHIHGDGYGVNHGGHYGHGGGH | SEQ ID No 636 |
| SFHKVKPQDPQGQEATDSEYSEIKIHKRETAETQACLRNHNPSSKEVRG | SEQ ID No 637 |
| NNSTSANRNVYEVEPTVSVVQGVFSNNGRLSQDPYDLPKNSHIPCHYD LLPVRDSSSSPKQEDSGGSSSNSSSSSE | SEQ ID No 638 |
| RREFRKALKSLLWRIASPSITSMRPFTATTKPEHEDQGLQAPAPPHAAAE PDLLYYPPGVVVYSGGRYDLLPSSSAY | SEQ ID No 639 |
| NELFIDSCCSNRYQERKEENHEKDWDQKSHDVSTDSSFEESSLFEKELE KFDTLRFGQLRKKIWIRMENPAYCLSAK | SEQ ID No 640 |
| NEFFIDSCCSYSYHGRKVEPEQEKWDEQSDQESTTSSFDEILAFYNDAS KFDGQPLGNFRRQLWLALDNPGYSVLSR | SEQ ID No 641 |
| DATDQESLELKPTSRAGIKQKGLLLSSSLMHSESELDSDDAIFTWPDREK GKLLHGQNGSVPNGQTPLKARSPREEIL | SEQ ID No 642 |
| SRGASIPGTPPTAGRVVSLSPEDAPGPSLRRSGGCSPSSDTVFGPGAP AAAGAEACRRENRGTLYGTRSFTVSVAQKR | SEQ ID No 643 |
| NKTFSPAQRHGNSGITMMRKKAKFSLRENPVEETKGEAFSDGNIEVKLC EQTEEKKKLKRHLALFRSELAENSPLDSGH | SEQ ID No 644 |
| YESHRAGCEKYEGPYPQHPFYSSASGDVIGGLSREEIRQMYESSELSRE EIQERMRVLELYANDPEFAAFVREQQVEEV | SEQ ID No 645 |
| FKNSDKEDDQEHPSEKQPSGAESGTLARASLALPTSSLSRTASQSSSH RGWEILRQNTLGHLNLGLNLSEGDGEEVYHF | SEQ ID No 646 |
| QDLKGDDTAVRDAHSKRDTKCQPQGSSGEEKGTPTTLRGGEASERKR PDSGCSTSKDTKYQSVYVISEEKDECVIATEV | SEQ ID No 647 |
| DHCVFIQRKISRPSQRPKTPLTDTSVYTELPNAEPRSKVVSCPRAPQSGL EGVF | SEQ ID No 648 |
| RDLPPLSSSEMEEFLTQESKKHENEFNEEVALTEIYKYIVKYFDEILNKLE RERGLEEAQKQLLHVKVLFDEKKKCKWM | SEQ ID No 649 |
| LGSPTSPGPGHYLRCDSTQPLLAGLTPSPKSYENLWFQASPLGTLVTPA PSQEDDCVFGPLLNFPLLQGIRVHGMEALGSF | SEQ ID No 650 |

TABLE 4-continued

Examples of naturally occurring C-terminal flanking regions of ITIM only intracellular domains (Table 4 comprises SEQ ID No 352 to SEQ ID No 685)

| Sequence | ID |
|---|---|
| LSQPGPTLPKTHVKTASLGLAGKARSPLLPVSVPTAPEVSEESHKPTED SANVYEQDDLSEQMASLEGLMKQLNAITGSAF | SEQ ID No 651 |
| ATECGQGEEKSEGPLGSQESESCGLRKEEKEPHADKDFCQEKQVAYC PSGKPEGLNYACLTHSGYGDGSD | SEQ ID No 652 |
| KELILAVDGVLSVHSLHIWSLTMNQVILSAHVATAASRDSQVVRREIAKAL SKSFTMHSLTIQMESPVDQDPDCLFCEDPCD | SEQ ID No 653 |
| TSFPRLPEDEPAPAAPLRGRKDEDAFLGDPDTDPDSFLKSARLQRLPSS SSEMGSQDGSPLRETRKDPFSAAAAECSCRQDG | SEQ ID No 654 |
| LEKERELQQLGITEYLRKNIAQLQPDMEAHYPGAHEELKLMETLMYSRP RKVLVEQTKNEYFELKANLHAEPDYLEVLEQQT | SEQ ID No 655 |
| KNSLKEANHDGDFGITLAELRALMELRSTDALRKIQESYGDVYGICTKLK TSPNEGLSGNPADLERREAVFGKNFIPPKKPKT | SEQ ID No 656 |
| YNCLDFPAGVVPVTTVTAEDEAQMEHYRGYFGDIWDKMLQKGMKKSV GLPVAVQCVALPWQEELCLRFMREVERLMTPEKQSS | SEQ ID No 657 |
| PAFDLLSRKMLGCPINDLNVILLFLRANISELISFSWLSVLCVLKDTTTQKH NIDTVVDFMTLLAGLEPSKPKHLTNSACDEHP | SEQ ID No 658 |
| SRRFQAAFQNVISSFHKQWHSQHDPQLPPAQRNIFLTECHFVELTEDIG PQFPCQSSMHNSHLPAALSSEQMSRTNYQSFHFNKT | SEQ ID No 659 |
| ELKTTRFHPNRQSSMYTVTRMESMTVVFDPNDADTTRSSRKKRATPRD PSFNGCSRRNSKSASATSSFISSPYTSVDEYS | SEQ ID No 660 |
| SRQCKQFAKDLLDQTRSSRELEIILNYRDDNSLIEEQSGNDLARLKLAIKY RQKEFVAQPNCQQLLASRWYDEFPGWRRRHWAVK | SEQ ID No 661 |
| VRKKQKAQHRCMRRVGRTGSRRSGYAFSHQEGFGELIMSGKNMRLSS LALSSFTTRSSSSWIESLRRKKSDSASSPSGGADKPLKG | SEQ ID No 662 |
| LLKLMFVNPPELPEQTTKALPVRFLFTDYNRLSSVGGETSLAEMIATLSD ACEREFGFLATRLFRVFKTEDTQGKKKWKKTCCLPS | SEQ ID No 663 |
| PPYLGKLDVSFQRACQCEGKDNRIPLLKEVFEAFPNTPINIDIKVNNNVLI KKVSELVKRYNREHLTVWGNANYEIVEKCYKENSD | SEQ ID No 664 |
| VVAAMQARHAHVPQLRWETMDVRKLDFPSASFDVVLEKGTLDALLAGE RDPWTVSSEGVHTVDQVLSEVGFQKGTRQLLGSRTQLE | SEQ ID No 665 |
| SAEVQAVLRKFDELDAVMSRLPHHSESRQEHERISRIHEEFKKKKNDPT FLEKKERCDYLKNKLSHIKQRIQEYDKVMNWDVQGYS | SEQ ID No 666 |
| AERVKELPSAGLVHYNFCTLPKRQFAPSYESRRQNQDRINKTVLYGTPR KCFVGQSKPNHPLLQAKPQSEPDYLEVLEKQTAISQL | SEQ ID No 667 |
| NLPPNPKRQQRKPKGNKNSILATEQEITYAELNLQKASQDFQGNDKTYH CKDLPSAPEK | SEQ ID No 668 |
| EKPESRTSIHNFMAHPEFRIEDSQPHIPLIDDTDLEEDAALKQNSSPPSSL NKNNSAIDSGINLTTDTSKSATSSSPGSPIHSLETSL | SEQ ID No 669 |
| EKPESRSSIHNFMTHPEFRIEDSEPHIPLIDDTDAEDDAPTKRNSSPPPSP NKNNNAVDSGIHLTIEMNKSATSSSPGSPLHSLETSL | SEQ ID No 670 |
| QGDPQRSPSSCNDLYATVKDFEKTPNSTLPPAGRPSEEPEPDYEAIQTL NREEEKATLGTNGHHGLVPKENDYESISDLQQGRDITRL | SEQ ID No 671 |
| KVAMIEPGYFKTAVTSKERFLKSFLEIWDRSSPEVKEAYGEKFVADYKKS AEQMEQKCTQDLSLVTNCMEHALIACHPRTRYSAGWDAK | SEQ ID No 672 |
| EKPESKTSIHNFMATPEFLINDYTHNIPLIDDTDVDENEERLRAPPPPSPN QNNNAIDSGIYLTTHVTKSATSSVFSSSPGSPLHSVETSL | SEQ ID No 673 |
| PAAPLAGPALPARRLSRASRPLSASQPSLPHGAPGPAASTRPASSSTPR LGPTPAARAAAPSPDRRDSASPGAAGGLDPQDSARSRLSSNL | SEQ ID No 674 |
| SKHFRKGFRTICAGLLGRAPGRASGRVCAAARGTHSGSVLERESSDLLH MSEAAGALRPCPGASQPCILEPCGPSWQGPKAGDSILTVDVA | SEQ ID No 675 |

TABLE 4-continued

Examples of naturally occurring C-terminal flanking regions of ITIM only intracellular domains (Table 4 comprises SEQ ID No 352 to SEQ ID No 685)

| Sequence | ID |
|---|---|
| SNAKIAYKQNKANTAQEQQYGSHEENLPADLEALQREIRMAQERLDLAV QAYSHQNNPHGPREKKAKVGSKAGSNKSTASSKSGDGKTSVWI | SEQ ID No 676 |
| QNEEESGEPEQAAGDAPPPYSSISAESAAYFDYKDESGFPKPPSYNVAT TLPSYDEAERTKAEATIPLVPGRDEDFVGRDDFDDADQLRIGNDG | SEQ ID No 677 |
| EGDPQTQLQDDKDPMLILRGRVPEGRALDSEVDPDPEGDLGVRGPVFG EPSAPPHTSGVSLGESRSSEVDVSDLGSRNYSARTDFYCLVSKDDM | SEQ ID No 678 |
| LLGDFLRACFVRFMNYCWCWDLEAGFPSYAEFDISGNVLGLIFNQGMIW MGSFYAPGLVGINVLRLLTSMYFQCWAVMSSNVPHERVFKASRSNN | SEQ ID No 679 |
| TIEPVQQAGCSATRLPGDGQTSAGDASLQDPPSYPPVQVIRARVSSGSS SEVSSINSDLEWDPEDVNLEGSKENVELLGSQVHQDSVRTAHLSDDD | SEQ ID No 680 |
| RRTLKQAFADCTVILCEHRIEAMLECQQFLVIEENKVRQYDSIQKLLNERS LFRQAISPSDRVKLFPHRNSSKCKSKPQIAALKEETEEEVQDTRL | SEQ ID No 681 |
| VKAFHSSLHESIQKPYNQKSIHSFMTHPEFAIEEELPRTPLLDEEEEENPD KASKFGTRVLLLDGEVTPYANTNNNAVDCNQVQLPQSDSSLQSLETSV | SEQ ID No 682 |
| NLPKGKKPAPQAAEPNNHTEYASIQTSPQPASEDTLTYADLDMVHLNRT PKQPAPKPEPSFSEYASVQVPRK | SEQ ID No 683 |
| TLQLAGTSPQKATTKLSSAQVDQVEVEYVTMASLPKEDISYASLTLGAED QEPTYCNMGHLSSHLPGRGPEEPTEYSTISRP | SEQ ID No 684 |
| ETGPKHIPLQTLLKFMVDIALGMEYLSNRNFLHRDLAARNCMLRDDMTV CVADFGLSKKIYSGDYYRQGRIAKMPVKWIAIESLADRVYTSKSDVWAF GVTMWEIATRGMTPYPGVQNHEMYDYLLHGHRLKQPEDCLDELYEIMY SCWRTDPLDRPTFSVLRLQLEKLLESLPDVRNQADVIYVNTQLLESSEGL AQGSTLAPLDLNIDPDSIIASCTPRAAISVVTAEVHDSKPHEGRYILNGGS EEWEDLTSAPSAAVTAEKNSVLPGERLVRNGVSWSHSSMLPLGSSLPD ELLFADDSSEGSEVLM | SEQ ID No 685 |

TABLE 5

Examples of naturally occurring intracellular domains between ITIM and ITSM from proteins that have ITIM.*ITSM motif and vary in length from 7-1882 (Table 4 comprises SEQ ID No 686 to SEQ ID No 717)

| Sequence | ID |
|---|---|
| KEEEMAD | SEQ ID No 686 |
| NFHGMNPSKDTS | SEQ ID No 687 |
| HFHKVQPQEPKVTD | SEQ ID No 688 |
| ELIKPHRAAKGAPTS | SEQ ID No 689 |
| SFQMVKPWDSRGQEATD | SEQ ID No 690 |
| QVSSAESHKDLGKKDTE | SEQ ID No 691 |
| SFSEMKSREPKDQEAPST | SEQ ID No 692 |
| SFQGLRLWEPADQEAPST | SEQ ID No 693 |
| NLPKGKKPAPQAAEPNNH | SEQ ID No 694 |
| NHSVIGPNSRLARNVKEAP | SEQ ID No 695 |
| DFQWREKTPEPPVPCVPEQ | SEQ ID No 696 |
| DHLALSRPRRLSTADPADAS | SEQ ID No 697 |
| SPTNNTVYASVTHSNRETEIWTPRENDTI | SEQ ID No 698 |
| DGLRDRRSFHGPYTVQAGLPLNPMGRTGLRGRGSLSCFGPNH | SEQ ID No 699 |
| MRIKMCLIKLCKSKAKSCENDLEMGMLNSKFKKTRYQAGMRNSENLTAN NTLSKP | SEQ ID No 700 |

TABLE 5-continued

Examples of naturally occurring intracellular domains between ITIM and ITSM from proteins that have ITIM.*ITSM motif and vary in length from 7-1882 (Table 4 comprises SEQ ID No 686 to SEQ ID No 717)

| Sequence | ID |
|---|---|
| QDLKGDDTAVRDAHSKRDTKCQPQGSSGEEKGTPTTLRGGEASERKR PDSGCSTSKD | SEQ ID No 701 |
| KQQMEKGPIDAITGEARYSLSEDKLIRQQIDYKTLTLHCVCPENEGSAQV PVKVLNCDSITQAKDKLLD | SEQ ID No 702 |
| TLQLAGTSPQKATTKLSSAQVDQVEVEYVTMASLPKEDISYASLTLGAED QEPTYCNMGHLSSHLPGRGPEEP | SEQ ID No 703 |
| EDDSDVEWKFARSKLWLSYFDDGKTLPPPFSLVPSPKSFVYFIMRIVNFP KCRRRRLQKDIEMGMGNSKSRLNLFTQSNSRVFESHSFNSILNQP | SEQ ID No 704 |
| RKVPSFTFTPTVTYQRGGEAVSSGGRPGLLNISEPAAQPWLADTWPNT GNNHNDCSISCCTAGNGNSDSNLTTYSRPADCIANYNNQLDNKQTNLM LPES | SEQ ID No 705 |
| GDQPVYLPTQMLVKFMADIASGMEYLSTKRFIHRDLAARNCMLNENMSV CVADFGLSKKIYNGDYYRQGRIAKMPVKWIAIESLADRVYTSKSDVWSF GVTMWEIATRGQ | SEQ ID No 706 |
| ETGPKHIPLQTLLKFMVDIALGMEYLSNRNFLHRDLAARNCMLRDDMTV CVADFGLSKKIYSGDYYRQGRIAKMPVKWIAIESLADRVYTSKSDVWAF GVTMWEIATRGM | SEQ ID No 707 |
| FEFCDLGDLKAYLRSEQEHMRGDSQTMLLQRMACEVAAGLAAMHKLHF LHSDLALRNCFLTSDLNVKVGDYGIGFSRYKEDYIETDDKKVFPLRWTAP ELVTSFQDRLLTADQ | SEQ ID No 708 |
| LEAPVGREARKWLQLAVFCSPLVPGQSHLQLRIYFLNNTPCALQWALTN EQPHGGRLRGPCQLFDFNGARGDQCLKLTYISEGWENVDDSSCQLVP HLHIWHGKCPFRSFCFRRKAADENEDCSALTNEIIVTMHTFQDGLE | SEQ ID No 709 |
| QRSLYDRPASYKKKSMLDSEVKNLLSDDNSEGLTLLDLLSFTYQVARGM EFLASKNCVHRDLAARNVLLAQGKIVKICDFGLARDIMHDSNYVSKGSTF LPVKWMAPESIFDNLYTTLSDVWSYGILLWEIFSLGGTPYPGMMVDS | SEQ ID No 710 |
| KECAGEPLFSLFCAIKQQMEKGPIDAITGEARYSLSEDKLIRQQIDYKTLV LSCVSPDNANSPEVPVKILNCDTITQVKEKILDAIFKNVPCSHRPKAADMD LEWRQGSGARMILQDEDITTKIENDWKRLNTLAHYQVPDGSVVALVSKQV | SEQ ID No 711 |
| TVTESYTTSDTLKPSVHVHDNRPASNVVVTERVVGPISGADLHGMLEMP DLRDGSNVIVTERVIAPSSSLPTSLTIHHPRESSNVVVTERVIQPTSGMIG SLSMHPELANAHNVIVTERVVSGAGVTGISGTTGISGGIGSSGLVGTSMG AGSGALSGAGISGGGIGLSSLGGTASIGHMRSSSDHHFNQTIGSASPST ARSRI | SEQ ID No 712 |
| NPEYFSAADVYVPDEWEVAREKITMSRELGQGSFGMVYEGVAKGVVKD EPETRVAIKTVNEAASMRERIEFLNEASVMKEFNCHHVVRLLGVVSQGQ PTLVIMELMTRGDLKSYLRSLRPEMENNPVLAPPSLSKMIQMAGEIADG MAYLNANKFVHRDLAARNCMVAEDFTVKIGDFGMTRDIYETDYYRKGG KGLLPVRWMSPESLKDGVF | SEQ ID No 713 |
| GGAYVGPTQNRILRLSKELGIETYKVNVSERLVQYVKGKTYPFRGAFPP VWNPIAYLDYNNLWRTIDNMGKEIPTDAPWEAQHADKWDKMTMKELID KICWTKTARRFAYLFVNINVTSEPHEVSALWFLWYVKQCGGTTRIFSVTN GGQERKFVGGSGQVSERIMDLLGDQVKLNHPVTHVDQSSDNIIIETLNH EHYECKYVINAIPPTLTAKIHFRPELPAERNQLIQRLPMGAVIKCMMYYKE AFWKKKDYCGCMIIEDEDAPISITLDDTKPDGSLPAIMGFILARKADRLAK LHKEIRKKKICELYAKVLGSQEALHPVHYEEKNWCEEQYSGGCYTAYFP PGIM | SEQ ID No 714 |
| GGSYVGPTQNRILRLAKELGLETYKVNEVERLIHHVKGKSYPFRGPFPPV WNPITYLDHNNFWRTMDDMGREIPSDAPWKAPLAEEWDNMTMKELLD KLCWTESAKQLATLFVNLCVTAETHEVSALWFLWYVKQCGGTTRIISTTN GGQERKFVGGSGQVSERIMDLLGDRVKLERPVIYIDQTRENVLVETLNH EMYEAKYVISAIPPTLGMKIHFNPPLPMMRNQMITRVPLGSVIKCIVYYKE PFWRKKDYCGTMIIDGEEAPVAYTLDDTKPEGNYAAIMGFILAHKARKLA RLTKEERLKKLCELYAKVLGSLEALEPVHYEEKNWCEEQYSGGCYTTYF PPGIL | SEQ ID No 715 |
| KGKKFIVVCGNITVDSVTAFLRNFLRDKSGEINTEIVFLGETPPSLELETIF KCYLAYTTFISGSAMKWEDLRRVAVESAEACLIIANPLCSDSHAEDISNIM RVLSIKNYDSTTRIIIQILQSHNKVYLPKIPSWNWDTGDNIICFAELKLGFIA QGCLVPGLCTFLTSLFVEQNKKVMPKQTWKKHFLNSMKNKILTQRLSDD FAGMSFPEVARLCFLKMHLLLIAIEYKSLFTDGFCGLILNPPPQVRIRKNTL | SEQ ID No 716 |

TABLE 5-continued

Examples of naturally occurring intracellular domains between ITIM and ITSM from proteins that have ITIM.*ITSM motif and vary in length from 7-1882 (Table 4 comprises SEQ ID No 686 to SEQ ID No 717)

| | |
|---|---|
| GFFIAETPKDVRRALFYCSVCHDDVFIPELITNCGCKSRSRQHITVPSVKR<br>MKKCLKGISSRISGQDSPPRVSASTSSISNFTTRTLQHDVEQDSDQLDSS<br>GMFHWCKPTSLDKVTLKRTGKSKYKFRNHIVACVFGDAHSAPMGLRNF<br>VMPLRASNYTRKELKDIVFIGSLDYLQREWRFLWNFPQIYILPGCALYSG<br>DLHAANIEQCSMCAVLSPPPQPSSNQTLVDTEAIMATLTIGSLQIDSSSD<br>PSPSVSEETPGYTNGHNEKSNCRKVPILTELKNPSNIHFIEQLGGLEGSL<br>QETNLHLSTAFSTGTVFSGSFLDSLLATAFYNYHVLELLQMLVTGGVSSQ<br>LEQHLDKDKVYGVADSCTSLLSGRNRCKLGLLSLHETILSDVNPRNTFG<br>QLFCGSLDLFGILCVGLYRIIDEEELNPENKRFVITRPANEFKLLPSDLVFC<br>AIPFSTACYKRNEEFSLQKSYEIVNKASQTTETHSDTNCPPTIDSVTE | |
| ASLIRGNRSNCALFSTNLDWLVSKLDRLEASSGILEVLYCVLIESPEVLNII<br>QENHIKSIISLLDKHGRNHKVLDVLCSLCVCNGVAVRSNQDLITENLLPGR<br>ELLLQTNLINYVTSIRPNIFVGRAEGTTQYSKWYFEVMVDEVTPFLTAQA<br>THLRVGWALTEGYTPYPGAGEGWGGNGVGDDLYSYGFDGLHLWTGH<br>VARPVTSPGQHLLAPEDVISCCLDLSVPSISFRINGCPVQGVFESFNLDG<br>LFFPVVSFSAGVKVRFLLGGRHGEFKFLPPPGYAPCHEAVLPRERLHLE<br>PIKEYRREGPRGPHLVGPSRCLSHTDFVPCPVDTVQIVLPPHLERIREKL<br>AENIHELWALTRIEQGWTYGPVRDDNKRLHPCLVDFHSLPEPERNYNLQ<br>MSGETLKTLLALGCHVGMADEKAEDNLKKTKLPKTYMMSNGYKPAPLD<br>LSHVRLTPAQTTLVDRLAENGHNVWARDRVGQGWSYSAVQDIPARRNP<br>RLVPYRLLDEATKRSNRDSLCQAVRTLLGYGYNIEPPDQEPSQVENQSR<br>CDRVRIFRAEKSYTVQSGRWYFEFEAVTTGEMRVGWARPELRPDVELG<br>ADELAYVFNGHRGQRWHLGSEPPFGRPWQPGDVVGCMIDLTENTIIFTLN<br>GEVLMSDSGSETAFREIEIGDGFLPVCSLGPGQVGHLNLGQDVSSLRFF<br>AICGLQEGFEPPFAINMQRPVTTWFSKGLPQFEPVPLEHPHYEVSRVDGT<br>VDTPPCLRLTHRTWGSQNSLVEMLFLRLSLPVQFHQHFRCTAGATPLAP<br>PGLQPPAEDEARAAEPDPDYENLRRSAGGWSEAENGKEGTAKEGAPG<br>GTPQAGGEAQPARAENEKDATTEKNKKRGFLFKAKKVAMMTQPPATPT<br>LPRLPHDVVPADNRDDPEIILNTT | SEQ ID No 717 |

TABLE 6

Examples of naturally occurring N-terminal flanking regions of ITSM only intracellular domains that could vary in length from 0-2002 (Table 6 comprises SEQ ID No 718 to SEQ ID No 805)

| | |
|---|---|
| V | |
| AM | |
| NLMSY | SEQ ID No 718 |
| SRFKRQ | SEQ ID No 719 |
| MDDSDTP | SEQ ID No 720 |
| YGKKRNR | SEQ ID No 721 |
| KSQWIKE | SEQ ID No 722 |
| CRGLAPEE | SEQ ID No 723 |
| RLCSAMKQ | SEQ ID No 724 |
| YRKREWIKE | SEQ ID No 725 |
| RKMKRSSSEIK | SEQ ID No 726 |
| FCNMRRPAHADIK | SEQ ID No 727 |
| LRTVKRANGGELK | SEQ ID No 728 |
| MEQHVGIDVLKRDP | SEQ ID No 729 |
| LEQHVDPHVLQNKP | SEQ ID No 730 |
| RNKDVKDAIRKIIN | SEQ ID No 731 |
| VDFRPPPQGPSGPEV | SEQ ID No 732 |
| DRYFALVQPFRLTRWR | SEQ ID No 733 |

TABLE 6-continued

Examples of naturally occurring N-terminal flanking regions of ITSM only intracellular domains that could vary in length from 0-2002 (Table 6 comprises SEQ ID No 718 to SEQ ID No 805)

| Sequence | ID |
|---|---|
| VRMTSEIETNIVAVERI | SEQ ID No 734 |
| MERLWGLFQRAQQLSPRSSQ | SEQ ID No 735 |
| MAEPQAESEPLLGGARGGGGDWPAGL | SEQ ID No 736 |
| PETKGVALPETMKDAENLGRKAKPKEN | SEQ ID No 737 |
| MEDEAVLDRGASFLKHVCDEEEVEGHH | SEQ ID No 738 |
| YKMYGSEMLHKRDPLDEDEDTDISYKKLKEEEMAD | SEQ ID No 739 |
| RHVSDLHGLTELILLPPPCPASFNADEDDRVDILGPQPESHQQLSASSH | SEQ ID No 740 |
| CSRAARGTIGARRTGQPLKEDPSAVPVFSVDYGELDFQWREKTPEPPVPCVPEQ | SEQ ID No 741 |
| RRKSIKKKRALRRFLETELVEPLTPSGTAPNQAQLRILKETELKRVKVLGSGAFG | SEQ ID No 742 |
| RIRQKKAQGSTSSTRLHEPEKNAREITQDTNDITYADLNLPKGKKPAPQAAEPNNH | SEQ ID No 743 |
| AVTISLAYSVKKMMKDNNLVRHLDACETMGNATAICSDKTGTLTTNRMTVVQSYLGD | SEQ ID No 744 |
| CCRKKRREEKYEKEVHHDIREDVPPPKSRTSTARSYIGSNHSSLGSMSPSNMEGYSK | SEQ ID No 745 |
| KRRQQKIRKYTMRRLLQETELVEPLTPSGAMPNQAQMRILKETELRKVKVLGSGAFG | SEQ ID No 746 |
| KYLQKPMYEVQWKVVEEINGNNYVYIDPTQLPYDHKWEFPRNRLSFGKTLGAGAFGKVVEA | SEQ ID No 747 |
| YTTYPLLKESALILLQTVPKQIDIRNLIKELRNVEGVEEVHELHVWQLAGSRIIATAHIKCEDP | SEQ ID No 748 |
| AANAIAQSCQPSFYDGTIIVKKLPYLPRILGRNIGSHHVRVEHFMNHSITTLAKDTPLEEVVKVVTSTDV | SEQ ID No 749 |
| WLHRRLPPQPIRPLPRFAPLVKTEPQRPVKEEEPKIPGDLDQEPSLLYADLDHLALSRPRRLSTADPADAS | SEQ ID No 750 |
| KKYQPYKVIKQKLEGRPETEYRKAQTFSGHEDALDDFGIYEFVAFPDVSGVSRIPSRSVPASDCVSGQDLHS | SEQ ID No 751 |
| MDEINNKIEEEKLVKANITLWEANMIKAYNASFSENSTGPPPFFVHPADVPRGPCWETMVGQEFVRLTVSDVL | SEQ ID No 752 |
| KTHRRKAARTAVGRNDTHPTTGSASPKHQKKSKLHGPTETSSCSGAAPTVEMDEELHYASLNFHGMNPSKDTS | SEQ ID No 753 |
| RVKTRRKKAAQPVQNTDDVNPVMVSGSRGHQHQFQTGIVSDHPAEAGPISEDEQELHYAVLHFHKVQPQEPKVTD | SEQ ID No 754 |
| IVLRRRRKRVNTKRSSRAFRAHLRAPLKGNCTHPEDMKLCTVIMKSNGSFPVNRRRVEAARRAQELEMEMLSSTSPPER | SEQ ID No 755 |
| KARRKQAAGRPEKMDDEDPIMGTITSGSRKKPWPDSPGDQASPPGDAPPLEEQKELHYASLSFSEMKSREPKDQEAPST | SEQ ID No 756 |
| KICRKEARKRAAAEQDVPSTLGPISQGHQHECSAGSSQDHPPPGAATYTPGKGEEQELHYASLSFQGLRLWEPADQEAPST | SEQ ID No 757 |
| QRVVCQRYAGANGPFPHEYVSGTPHVPLNFIAPGGSQHGPFTGIACGKSMMSSVSLMGGRGGVPLYDRNHVTGASSSSSSTKA | SEQ ID No 758 |
| VRSCRKKSARPAAGVGDTGIEDANAVRGSASQGPLTEPWAEDSPPDQPPPASARSSVGEGELQYASLSFQMVKPWDSRGQEATD | SEQ ID No 759 |
| FVAKIARPKNRAFSIRFTDTAVVAHMDGKPNLIFQVANTRPSPLTSVRVSAVLYQERENGKLYQTSVDFHLDGISSDECPFFIFPL | SEQ ID No 760 |

TABLE 6-continued

Examples of naturally occurring N-terminal flanking regions of ITSM only intracellular domains that could vary in length from 0-2002 (Table 6 comprises SEQ ID No 718 to SEQ ID No 805)

| Sequence | SEQ ID |
|---|---|
| QLRRRGKTNHYQTTVEKKSLTIYAQVQKPGPLQKKLDSFPAQDPCTTIY VAATEPVPESVQETNSI | SEQ ID No 761 |
| ILAKISRPKKRAKTITFSKNAVISKRGGKLCLLIRVANLRKSLLIGSHIYGKL LKTTVTPEGETIILDQININFVVDAGNENLFFISPL | SEQ ID No 762 |
| FLAKIARPKKRAETIRFSQHAVVASHNGKPCLMIRVANMRKSLLIGCQVT GKLLQTHQTKEGENIRLNQVNVTFQVDTASDSPFLILPL | SEQ ID No 763 |
| WFLKRERQEEYIEEKKRVDICRETPNICPHSGENTEYDTIPHTNRTILKED PAN | SEQ ID No 764 |
| KCYFLRKAKAKQMPVEMSRPAVPLLNSNNEKMSDPNMEANSHYGHND DVRNHAMKPINDNKEPLNSDVQYTEVQVSSAESHKDLGKKDTE | SEQ ID No 765 |
| LRKRRDSLSLSTQRTQGPAESARNLEYVSVSPTNNTVYASVTHSNRETE IWTPRENDTI | SEQ ID No 766 |
| RLFKRRQGRIFPEGSCLNTFTKNPYAASKKTIYTYIMASRNTQPAESRIYD EILQSKVLPSKEEPVN | SEQ ID No 767 |
| RRHQGKQNELSDTAGREINLVDAHLKSEQTEASTRQNSQVLLSETGIYD NDPDLCFRMQEGSEVYSNPCLEENKPGIVYASLNHSVIGPNSRLARNVK EAP | SEQ ID No 768 |
| KYRHKRFAVSEQGNIPHSHDWVWLGNEVELLENPVDITLPSEECTTMID RGLQFEERNFLLNGSSQKTFHSQLLRPSDYVYEKEIKNEPMNSSGPKRK RVKF | SEQ ID No 769 |
| NSSYQEIEDDSDVEWKFARSKLWLSYFDDGKTLPPPFSLVPSPKSFVYFI MRIVNFPKCRRRRLQKDIEMGMGNSKSRLNLFTQSNSRVFESHSFNSIL NQP | SEQ ID No 770 |
| WRMMKYQQKAAGMSPEQVLQPLEGDLCYADLTLQLAGTSPQKATTKLS SAQVDQVEVEYVTMASLPKEDISYASLTLGAEDQEPTYCNMGHLSSHLP GRGPEEP | SEQ ID No 771 |
| NNSYQEIEEDADVEWKFARAKLWLSYFDEGRTLPAPFNLVPSPKSFYYLI MRIKMCLIKLCKSKAKSCENDLEMGMLNSKFKKTRYQAGMRNSENLTAN NTLSKP | SEQ ID No 772 |
| QSVFNKRKSRVRHYLVKCPQNSSGETVTSVTSLAPLQPKKGKRQKEKP DIPPAVPAKAPIAPTFHKPKLLKPQRKVTLPKIAEENLTYAELELIKPHRAA KGAPTS | SEQ ID No 773 |
| YRHRKKRNGLTSTYAGIRKVPSFTFTPTVTYQRGGEAVSSGGRPGLLNI SEPAAQPWLADTWPNTGNNHNDCSISCCTAGNGNSDSNLTTYSRPAD CIANYNNQLDNKQTNLMLPES | SEQ ID No 774 |
| RYQRWKSKLYSIVCGKSTPEKEGELEGTTTKPLAPNPSFSPTPGFTPTL GFSPVPSSTFTSSSTYTPGDCPNFAAPRREVAPPYQGADPILATALASD PIPNPLQKWEDSAHKPQSLDTDDPA | SEQ ID No 775 |
| VRLRLQKHRPPADPCRGETETMNNLANCQREKDISVSIIGATQIKNTNKK ADFHGDHSADKNGFKARYPAVDYNLVQDLKGDDTAVRDAHSKRDTKC QPQGSSGEEKGTPTTLRGGEASERKRPDSGCSTSKD | SEQ ID No 776 |
| RAWVVFKLSSAPRLHEQRVRDIQKQVREWKEQGSKTFMCTGRPGWLT VSLRVGKYKKTHKNIMINLMDILEVDTKKQIVRVEPLVTMGQVTALLTSIG WTLPVLPELDDLTVGGLIMGTGIESSSHKYGLFQHIC | SEQ ID No 777 |
| TRDLVDDMGRHKSDRAINNRPCQILMGKSFKQKKWQDLCVGDVVCLRK DNIVPADMLLLASTEPSSLCYVETVDIDGETNLKFRQALMVTHKELATIKK MASFQGTVTCEAPNSRMHHFVGCLEWNDKKYSLDIGNLLLRGCRIRNTD | SEQ ID No 778 |
| VFDPLGGKMAPYSSAGPSHLDSHDSSQLLNGLKTAATSVWETRIKLLCC CIGKDDHTRVAFSSTAELFSTYFSDTDLVPSDIAAGLALLHQQQDNIRNN QEPAQVVCHAPGSSQEADLDAELENCHHYMQFAAAAYGWPLYIYRNPL TGLCRIGGDCCRSRT | SEQ ID No 779 |
| WRRKRKEKQSETSPKEFLTIYEDVKDLKTRRNHEQEQTFPGGGSTIYSM IQSQSSAPTSQEPAYTLYSLIQPSRKSGSRKRNHSPSFNS | SEQ ID No 780 |
| RKRNNSRLGNGVLYASVNPEYFSAADVYVPDEWEVAREKITMSRELGQ GSFGMVYEGVAKGVVKDEPETRVAIKTVNEAASMRERIEFLNEASVMKE | SEQ ID No 781 |

TABLE 6-continued

Examples of naturally occurring N-terminal flanking regions of ITSM only intracellular domains that could vary in length from 0-2002 (Table 6 comprises SEQ ID No 718 to SEQ ID No 805)

| Sequence | ID |
|---|---|
| FNCHHVVRLLGVVSQGQPTLVIMELMTRGDLKSYLRSLRPEMENNPVLA PPSLSKMIQMAGEIADGMAYLNANKFVHRDLAARNCMVAEDFTVKIGDF GMTRDIYETDYYRKGGKGLLPVRWMSPESLKDGVF | |
| NKCGRRNKFGINRPAVLAPEDGLAMSLHFMTLGGSSLSPTEGKGSGLQ GHIIENPQYFSDACVHHIKRRDIVLKWELGEGAFGKVFLAECHNLLPEQD KMLVAVKALKEASESARQDFQREAELLTMLQHQHIVRFFGVCTEGRPLL MVFEYMRHGDLNRFLRSHGPDAKLLAGGEDVAPGPLGLGQLLAVASQV AAGMVYLAGLHFVHRDLATRNCLVGQGLVVKIGDFGMSRDIYS | SEQ ID No 782 |
| KLARHSKFGMKGPASVISNDDDSASPLHHISNGSNTPSSSEGGPDAVIIG MTKIPVIENPQYFGITNSQLKPDTFVQHIKRHNIVLKRELGEGAFGKVFLA ECYNLCPEQDKILVAVKTLKDASDNARKDFHREAELLTNLQHEHIVKFYG VCVEGDPLIMVFEYMKHGDLNKFLRAHGPDAVLMAEGNPPTELTQSQM LHIAQQIAAGMVYLASQHFVHRDLATRNCLVGENLLVKIGDFGMSRDVYS | SEQ ID No 783 |
| NCVSCCKDPEIDFKEFEDNFDDEIDFTPPAEDTPSVQSPAEVFTLSVPNI SLPAPSQFQPSVEGLKSQVARHSLNYIQEIGNGWFGKVLLGEIYTGTSVA RVIVKELKASANPKEQDTFLKNGEPYYILQHPNILQCVGQCVEAIPYLLVF EFCDLGDLKAYLRSEQEHMRGDSQTMLLQRMACEVAAGLAAMHKLHFL HSDLALRNCFLTSDLNVKVGDYGIGFSRYKEDYIETDDKKVFPLRWTAPE LVTSFQDRLLTADQ | SEQ ID No 784 |
| YKRKTQDADRTLKRLQLQMDNLESRVALECKEAFAELQTDINELTNHMD EVQIPFLDYRTYAVRVLFPGIEAHPVLKELDTPPNVEKALRLFGQLLHSRA FVLTFIHTLEAQSSFSMRDRGTVASLTMVALQSRLDYATGLLKQLLADLIE KNLESKNHPKLLLRRTESVAEKMLTNWFTFLLHKFLKECAGEPLFLLYCA IKQQMEKGPIDAITGEARYSLSEDKLIRQQIDYKTLTLHCVCPENEGSAQV PVKVLNCDSITQAKDKLLD | SEQ ID No 785 |
| KRKGRCSVPAFCSSQAEAPADTPEPTAGHTLYSVLSQGYEKLDTPLRPA RQQPTPTSDSSSDSNLTTEEDEDRPEVHKPISGRYEVFDQVTQEGAGH DPAPEGQADYDPVTPYVTEVESVVGENTMYAQVFNLQGKTPVSQKEES SA | SEQ ID No 786 |
| KRVQETKFGNAFTEEDSELVVNYIAKKSFCRRAIELTLHSLGVSEELQNK LEDVVIDRNLLILGKILGEGEFGSVMEGNLKQEDGTSLKVAVKTMKLDNS SQREIEEFLSEAACMKDFSHPNVIRLLGVCIEMSSQGIPKPMVILPFMKY GDLHTYLLYSRLETGPKHIPLQTLLKFMVDIALGMEYLSNRNFLHRDLAA RNCMLRDDMTVCVADFGLSKKIYSGDYYRQGRIAKMPVKWIAIESLADR VYTSKSDVWAFGVTMWEIATRGM | SEQ ID No 787 |
| SRQQRRREARGRGDASGLKRNSERKTPEGRASPAPGSGHPEGPGAHL DMNSLDRAQAAKNKGNKYFKAGKYEQAIQCYTEAISLCPTEKNVDLSTF YQNRAAAFEQLQKWKEVAQDCTKAVELNPKYVKALFRRAKAHEKLDNK KECLEDVTAVCILEGFQNQQSMLLADKVLKLLGKEKAKEKYKNREPLMP SPQFIKSYFSSFTDDIISQPMLKGEKSDEDKDKEGEALEVKENSGYLKAK QYMEEENYDKIISECSKEIDAEGKYMAEALLLRA | SEQ ID No 788 |
| LRKRRKETRFGQAFDSVMARGEPAVHFRAARSFNRERPERIEATLDSLG ISDELKEKLEDVLIPEQQFTLGRMLGKGEFGSVREAQLKQEDGSFVKVA VKMLKADIIASSDIEEFLREAACMKEFDHPHVAKLVGVSLRSRAKGRLPIP MVILPFMKHGDLHAFLLASRIGENPFNLPLQTLIRFMVDIACGMEYLSSRN FIHRDLAARNCMLAEDMTVCVADFGLSRKIYSGDYYRQGCASKLPVKWL ALESLADNLYTVQSDVWAFGVTMWEIMTRGQ | SEQ ID No 789 |
| HRRKKETRYGEVFEPTVERGELVVRYRVRKSYSRRTTEATLNSLGISEE LKEKLRDVMVDRHKVALGKTLGEGEFGAVMEGQLNQDDSILKVAVKTM KIAICTRSELEDFLSEAVCMKEFDHPNVMRLIGVCFQGSERESFPAPVVIL PFMKHGDLHSFLLYSRLGDQPVYLPTQMLVKFMADIASGMEYLSTKRFI HRDLAARNCMLNENMSVCVADFGLSKKIYNGDYYRQGRIAKMPVKWIAI ESLADRVYTSKSDVWSFGVTMWEIATRGQ | SEQ ID No 790 |
| KRIELDDSISASSSSQGLSQPSTQTTQYLRADTPNNATPITSYPTLRIEKN DLRSVTLLEAKGKVKDIAISRERITLKDVLQEGTFGRIFHGILIDEKDPNKE KQAFVKTVKDQASEIQVTMMLTESCKLRGLHHRNLLPITHVCIEEGEKPM VILPYMNWGNLKLFLRQCKLVEANNPQAISQQDLVHMAIQIACGMSYLA RREVIHKDLAARNCVIDDTLQVKITDNALSRDLFPMDYHCLGDNENRPVR WMALESLVNNEFSSASDVWAFGVTLWELMTLGQ | SEQ ID No 791 |
| NCRTWWQVLDSLLNSQRKRLHNAASKLHKLKSEGFMKVLKCEVELMAR MAKTIDSFTQNQTRLVVIIDGLDACEQDKVLQMLDTVRVLFSKGPFIAIFA SDPHIIIKAINQNLNSVLRDSNINGHDYMRNIVHLPVFLNSRGLSNARKFL VTSATNGDVPCSDTTGIQEDADRRVSQNSLGEMTKLGSKTALNRRDTY RRQMQRTITRQMSFDLTKLLVTEDWFSDISPQTMRRLLNIVSVTGRLLR ANQISFNWDRLASWINLTEQWPYRTSWLILYLEETEGIPDQMTLK | SEQ ID No 792 |

TABLE 6-continued

Examples of naturally occurring N-terminal flanking regions of ITSM only intracellular domains that could vary in length from 0-2002 (Table 6 comprises SEQ ID No 718 to SEQ ID No 805)

| Sequence | ID |
|---|---|
| MFNYTFQQVQEHTDQIWKFQRHDLIEEYHGRPAAPPPFILLSHLQLFIKR VVLKTPAKRHKQLKNKLEKNEEAALLSWEIYLKENYLQNRQFQQKQRPE QKIEDISNKVDAMVDLLDLDPLKRSGSMEQRLASLEEQVAQTAQALHWI VRTLRASGFSSEADVPTLASQKAAEEPDAEPGGRKKTEEPGDSYHVNA RHLLYPNCPVTRFPVPNEKVPWETEFLIYDPPFYTAERKDAAAMDPMGD TLEPLSTIQYNVVDGLRDRRSFHGPYTVQAGLPLNPMGRTGLRGRGSLS CFGPNH | SEQ ID No 793 |
| AYKRKSRESDLTLKRLQMQMDNLESRVALECKEAFAELQTDIHELTSDL DGAGIPFLDYRTYTMRVLFPGIEDHPVLRDLEVPGYRQERVEKGLKLFA QLINNKVFLLSFIRTLESQRSFSMRDRGNVASLIMTVLQSKLEYATDVLKQ LLADLIDKNLESKNHPKLLLRRTESVAEKMLTNWFTFLLYKFLKECAGEPL FSLFCAIKQQMEKGPIDAITGEARYSLSEDKLIRQQIDYKTLVLSCVSPDN ANSPEVPVKILNCDTITQVKEKILDAIFKNVPCSHRPKAADMDLEWRQGS GARMILQDEDITTKIENDWKRLNTLAHYQVPDGSVVALVSKQV | SEQ ID No 794 |
| RWHCPRRLLGACWTLNGQEEPVSQPTPQLENEVSRQHLPATLPEMVA FYQELHTPTQGQTMVRQLMHKLLVFSAREVDHRGGCLMLQDTGISLLIP PGAVAVGRQERVSLILVWDLSDAPSLSQAQGLVSPVVACGPHGASFLK PCTLTFKHCAEQPSHARTYSSNTTLLDAKVWRPLGRPGAHASRDECRIH LSHFSLYTCVLEAPVGREARKWLQAVFCSPLVPGQSHLQLRIYFLNNTP CALQWALTNEQPHGGRLRGPCQLFDFNGARGDQCLKLTYISEGWENV DDSSCQLVPHLIWHGKCPFRSFCFRRKAADENEDCSALTNEIIVTMHT FQDGLE | SEQ ID No 795 |
| KQKPRYEIRWRVIESISPDGHEYIYVDPMQLPYDSRWEFPRDGLVLGRV LGSGAFGKVVEGTAYGLSRSQPVMKVAVKMLKPTARSSEKQALMSELKI MTHLGPHLNIVNLLGACTKSGPIYIITEYCFYGDLVNYLHKNRDSFLSHHP EKPKKELDIFGLNPADESTRSYVILSFENNGDYMDMKQADTTQYVPMLE RKEVSKYSDIQRSLYDRPASYKKKSMLDSEVKNLLSDDNSEGLTLLDLLS FTYQVARGMEFLASKNCVHRDLAARNVLLAQGKIVKICDFGLARDIMHD SNYVSKGSTFLPVKWMAPESIFDNLYTTLSDVWSYGILLWEIFSLGGTPY PGMMVDS | SEQ ID No 796 |
| CCCKQRQPEGLGTRFAPVPEGGEGVMQSWRIEGAHPEDRDVSNICAP MTASNTQDRMDSSEIYTNTYAAGGTVEGGVSGVELNTGMGTAVGLMAA GAAGASGAARKRSSTMGTLRDYADADINMAFLDSYFSEKAYAYADEDE GRPANDCLLIYDHEGVGSPVGSIGCCSWIVDDLDESCMETLDPKFRTLA EICLNTEIEPFPSHQACIPISTDLPLLGPNYFVNESSGLTPSEVEFQEEMA ASEPVVHGDIIVTETYGNADPCVQPTTIIFDPQLAPNVVVTEAVMAPVYDI QGNICVPAELADYNNVIYAERVLASPGVPDMSNSSTTEGCMGPVMSGNI LVGPEIQVMQMMSPDLPIGQTVGSTSPMTSRHRV | SEQ ID No 797 |
| SNKCDVVVVGGGISGMAAAKLLHDSGLNVVVLEARDRVGGRTYTLRNQ KVKYVDLGGSYVGPTQNRILRLAKELGLETYKVNEVERLIHHVKGKSYPF RGPFPPVWNPITYLDHNNFWRTMDDMGREIPSDAPWKAPLAEEWDNM TMKELLDKLCWTESAKQLATLFVNLCVTAETHEVSALWFLWYVKQCGG TTRIISTTNGGQERKFVGGSGQVSERIMDLLGDRVKLERPVIYIDQTREN VLVETLNHEMYEAKYVISAIPPTLGMKIHFNPPLPMMRNQMITRVPLGSVI KCIVYYKEPFWRKKDYCGTMIIDGEEAPVAYTLDDTKPEGNYAAIMGFIL AHKARKLARLTKEERLKKLCELYAKVLGSLEALEPVHYEEKNWCEEQYS GGCYTTYFPPGIL | SEQ ID No 798 |
| MENQEKASIAGHMFDVVVIGGGISGLSAAKLLTEYGVSVLVLEARDRVG GRTYTIRNEHVDYVDVGGAYVGPTQNRILRLSKELGIETYKVNVSERLVQ YVKGKTYPFRGAFPPVWNPIAYLDYNNLWRTIDNMGKEIPTDAPWEAQH ADKWDKMTMKELIDKICWTKTARRFAYLFVNINVTSEPHEVSALWFLWY VKQCGGTTRIFSVTNGGQERKFVGGSGQVSERIMDLLGDQVKLNHPVT HVDQSSDNIIIETLNHEHYECKYVINAIPPTLTAKIHFRPELPAERNQLIQRL PMGAVIKCMMYYKEAFWKKKDYCGCMIIEDEDAPISITLDDTKPDGSLPA IMGFILARKADRLAKLHKEIRKKKICELYAKVLGSQEALHPVHYEEKNWC EEQYSGGCYTAYFPPGIM | SEQ ID No 799 |
| CCDCGGAPRSAAGFEPVPECSDGAIHSWAVEGPQPEPRDITTVIPQIPP DNANIIECIDNSGVYTNEYGGREMQDLGGGERMTGFELTEGVKTSGMP EICQEYSGTLRRNSMRECREGGLNMNFMESYFCQKAYAYADEDEGRP SNDCLLIYDIEGVGSPAGSVGCCSFIGEDLDDSFLDTLGPKFKKLADISLG KESYPDLDPSWPPQSTEPVCLPQETEPVVSGHPPISPHFGTTTVISESTY PSGPGVLHPKPILDPLGYGNVTVTESYTTSDTLKPSVHVHDNRPASNVV VTERVVGPISGADLHGMLEMPDLRDGSNVIVTERVIAPSSSLPTSLTIHHP RESSNVVVTERVIQPTSGMIGSLSMHPELANAHNVIVTERVVSGAGVTGI SGTTGISGGIGSSLVGTSMGAGSGALSGAGISGGGIGLSSLGGTASIG HMRSSSDHHFNQTIGSASPSTARSRI | SEQ ID No 800 |

TABLE 6-continued

Examples of naturally occurring N-terminal flanking regions of ITSM only intracellular domains that could vary in length from 0-2002 (Table 6 comprises SEQ ID No 718 to SEQ ID No 805)

| Sequence | ID |
|---|---|
| NLEGVMNQADAPRPLNWTIRKLCHAAFLPSVRLLKAQKSWIERAFYKRE CVHIIPSTKDPHRCCCGRLIGQHVGLTPSISVLQNEKNESRLSRNDIQSE KWSISKHTQLSPTDAFGTIEFQGGGHSNKAMYVRVSFDTKPDLLLHLMT KEWQLELPKLLISVHGGLQNFELQPKLKQVFGKGLIKAAMTTGAWIFTGG VNTGVIRHVGDALKDHASKSRGKICTIGIAPWGIVENQEDLIGRDVVRPY QTMSNPMSKLTVLNSMHSHFILADNGTTGKYGAEVKLRRQLEKHISLQKI NTRCLPFFSLDSRLFYSFWGSCQLDSVGIGQGVPVVALIVEGGPNVISIV LEYLRDTPPVPVVVCDGSGRASDILAFGHKYSEEGGLINESLRDQLLVTI QKTFTYTRTQAQHLFIILMECMKKKELITVFRMGSEGHQDIDLAILTALLK GANASAPDQLSLALAWNRVDIARSQIFIYGQQWPVGSLEQAMLDALVLD RVDFVKLLIENGVSMHRFLTISRLEELYNTRHGPSN | SEQ ID No 801 |
| ELFANKRKYTSSYEALKGKKFIVVCGNITVDSVTAFLRNFLRDKSGEINTE IVFLGETPPSLELETIFKCYLAYTTFISGSAMKWEDLRRVAVESAEACLIIA NPLCSDSHAEDISNIMRVLSIKNYDSTTRIIIQILQSHNKVYLPKIPSWNWD TGDNIICFAELKLGFIAQGCLVPGLCTFLTSLFVEQNKKVMPKQTWKKHF LNSMKNKILTQRLSDDFAGMSFPEVARLCFLKMHLLLIAIEYKSLFTDGFC GLILNPPPQVRIRKNTLGFFIAETPKDVRRALFYCSVCHDDVFIPELITNCG CKSRSRQHITVPSVKRMKKCLKGISSRISGQDSPPRVSASTSSISNFTTR TLQHDVEQDSDQLDSSGMFHWCKPTSLDKVTLKRTGKSKYKFRNHIVA CVFGDAHSAPMGLRNFVMPLRASNYTRKELKDIVFIGSLDYLQREWRFL WNFPQIYILPGCALYSGDLHAANIEQCSMCAVLSPPPQPSSNQTLVDTE AIMATLTIGSLQIDSSSDPSPSVSEETPGYTNGHNEKSNCRKVPILTELKN PSNIHFIEQLGGLEGSLQETNLHLSTAFSTGTVFSGSFLDSLLATAFYNYH VLELLQMLVTGGVSSQLEQHLDKDKVYGVADSCTSLLSGRNRCKLGLLS LHETILSDVNPRNTFGQLFCGSLDLFGILCVGLYRIIDEEELNPENKRFVIT RPANEFKLLPSDLVFCAIPFSTACYKRNEEFSLQKSYEIVNKASQTTETH SDTNCPPTIDSVTE | SEQ ID No 802 |
| QFEELVYLWMERQKSGGNYSRHRAQTEKHVVLCVSSLKIDLLMDFLNEF YAHPRLQDYYVVILCPTEMDVQVRRVLQIPLWSQRVIYLQGSALKDQDL MRAKMDNGEACFILSSRNEVDRTAADHQTILRAWAVKDFAPNCPLYVQI LKPENKFHVKFADHVVCEEECKYAMLALNCICPATSTLITLLVHTSRGQE GQESPEQWQRMYGRCSGNEVYHIRMGDSKFFREYEGKSFTYAAFHAH KKYGVCLIGLKREDNKSILLNPGPRHILAASDTCFYINITKEENSAFIFKQE EKRKKRAFSGQGLHEGPARLPVHSIIASMGTVAMDLQGTEHRPTQSGG GGGGSKLALPTENGSGSRRPSIAPVLELADSSALLPCDLLSDQSEDEVT PSDDEGLSVVEYVKGYPPNSPYIGSSPTLCHLLPVKAPFCCLRLDKGCK HNSYEDAKAYGFKNKLIIVSAETAGNGLYNFIVPLRAYYRSRKELNPIVLL LDNKPDHHFLEAICCFPMVYYMEGSVDNLDSLLQCGIIYADNLVVVDKES TMSAEEDYMADAKTIVNVQTMFRLFPSLSITTELTHPSNMRFMQFRAKD SYSLALSKLEKRERENGSNLAFMFRLPFAAGRVFSISMLDTLLYQSFVKD YMITITRLLLGLDTTPGSGYLCAMKITEGDLWIRTYGRLFQKLCSSSAEIPI GIYRTESHVFSTSESQISVNVEDCEDTREVKGPWGSRAGTGGSSQGRH TGGGDPAEHPLLRRKSLQWARRLSRKAPKQAGRAAAAEWISQQRLSLY RRSERQELSELVKNRMKHLGLPT | SEQ ID No 803 |
| MSGGASATGPRRGPPGLEDTTSKKKQKDRANQESKDGDPRKETGSRY VAQAGLEPLASGDPSASASHAAGITGSRHRTRLFFPSSSGSASTPQEEQ TKEGACEDPHDLLATPTPELLLDWRQSAEEVIVKLRVGVGPLQLEDVDA AFTDTDCVVRFAGGGQWGGVFYAEIKSSCAKVQTRKGSLLHLTLPKKVP MLTWPSLLVEADEQLCIPPLNSQTCLLGSEENLAPLAGEKAVPPGNDPV SPAMVRSRNPGKDDCAKEEMAVAADAATLVDEPESMVNLAFVKNDSYE KGPDSVVVHVYVKEICRDTSRVLFREQDFTLIFQTRDGNFLRLHPGCGP HTTFRWQVKLRNLIEPEQCTFCFTASRIDICLRKRQSQRWGGLEAPAAR VGGAKVAVPTGPTPLDSTPPGGAPHPLTGQEEARAVEKDKSKARSEDT GLDSVATRTPMEHVTPKPETHLASPKPTCMVPPMPHSPVSGDSVEEE EEEKKVCLPGFTGLVNLGNTCFMNSVIQSLSNTRELRDFFHDRSFEAEIN YNNPLGTGGRLAIGFAVLLRALWKGTHHAFQPSKLKAIVASKASQFTGY AQHDAQEFMAFLLDGLHEDLNRIQNKPYTETVDSDGRPDEVVAEEAWQ RHKMRNDSFIVDLFQGQYKSKLVCPVCAKVSITFDPFLYLPVPLPQKQKV LPVFYFAREPHSKPIKFLVSVSKENSTASEVLDSLSQSVHVKPENLRLAE VIKNRFHRVFLPSHSLDTVSPSDTLLCFELLSSELAKERVVVLEVQQRPQ VPSVPISKCAACQRKQQSEDEKLKRCTRCYRVGYCNQLCQKTHWPDH KGLCRPENIGYPPFLSVSVPASRLTYARLAQLLEGYARYSVSVFQPPFQPG RMALESQSPGCTTLLSTGSLEAGDSERDPIQPPELQLVTPMAEGDTGLP RVWAAPDRGPVPSTSGISSEMLASGPIEVGSLPAGERVSRPEAAVPGY QHPSEAMNAHTPQFFIYKIDSSNREQRLEDKGDTPLELGDDCSLALVWR NNERLQEFVLVASKELECAEDPGSAGEAARAGHFTLDQCLNLFTRPEVL APEEAWYCPQCKQHREASKQLLLWRLPNVLIVQLKRFSFRSPIWRDKIN DLVEFPVRNLDLSKFCIGQKEEQLPSYDLYAVINHYGGMIGGHYTACARL PNDRSSQRSDVGWRLFDDSTVTTVDESQVV | SEQ ID No 804 |
| MADGGEGEDEIQFLRTDDEVVLQCTATIHKEQQKLCLAAEGFGNRLCFL ESTSNSKNVPPDLSICTFVLEQSLSVRALQEMLANTVEKSEGQVDVEKW | SEQ ID No 805 |

TABLE 6-continued

Examples of naturally occurring N-terminal flanking regions of ITSM only intracellular domains that could vary in length from 0-2002 (Table 6 comprises SEQ ID No 718 to SEQ ID No 805)

KFMMKTAQGGGHRTLLYGHAILLRHSYSGMYLCCLSTSRSSTDKLAFDV
GLQEDTTGEACWWTIHPASKQRSEGEKVRVGDDLILVSVSSERYLHLSY
GNGSLHVDAAFQQTLWSVAPISSGSEAAQGYLIGGDVLRLLHGHMDEC
LTVPSGEHGEEQRRTVHYEGGAVSVHARSLWRLETLRVAWSGSHIRW
GQPFRLRHVTTGKYLSLMEDKNLLLMDKEKADVKSTAFTFRSSKEKLDV
GVRKEVDGMGTSEIKYGDSVCYIQHVDTGLWLTYQSVDVKSVRMGSIQ
RKAIMHHEGHMDDGISLSRSQHEESRTARVIRSTVFLFNRFIRGLDALSK
KAKASTVDLPIESVSLSLQDLIGYFHPPDEHLEHEDKQNRLRALKNRQNL
FQEEGMINLVLECIDRLHVYSSAAHFADVAGREAGESWKSILNSLYELLA
ALIRGNRKNCAQFSGSLDWLISRLERLEASSGILEVLHCVLVESPEALNIIK
EGHIKSIISLLDKHGRNHKVLDVLCSLCVCHGVAVRSNQHLICDNLLPGR
DLLLQTRLVNHVSSMRPNIFLGVSEGSAQYKKWYYELMVDHTEPFVTAE
ATHLRVGWASTEGYSPYPGGGEEWGGNGVGDDLFSYGFDGLHLWSG
CIARTVSSPNQHLLRTDDVISCCLDLSAPSISFRINGQPVQGMFENFNIDG
LFFPVVSFSAGIKVRFLLGGRHGEFKFLPPPGYAPCYEAVLPKEKLKVEH
SREYKQERTYTRDLLGPTVSLTQAAFTPIPVDTSQIVLPPHLERIREKLAE
NIHELWVMNKIELGWQYGPVRDDNKRQHPCLVEFSKLPEQERNYNLQM
SLETLKTLLALGCHVGISDEHAEDKVKKMKLPKNYQLTSGYKPAPMDLSF
IKLTPSQEAMVDKLAENAHNVWARDRIRQGWTYGIQQDVKNRRNPRLV
PYTLLDDRTKKSNKDSLREAVRTLLGYGYNLEAPDQDHAARAEVCSGT
GERFRIFRAEKTYAVKAGRWYFEFETVTAGDMRVGWSRPGCQPDQEL
GSDERAFAFDGFKAQRWHQGNEHYGRSWQAGDVVGCMVDMNEHTM
MFTLNGEILLDDSGSELAFKDFDVGDGFIPVCSLGVAQVGRMNFGKDVS
TLKYFTICGLQEGYEPFAVNTNRDITMWLSKRLPQFLQVPSNHEHIEVTRI
DGTIDSSPCLKVTQKSFGSQNSNTDIMFYRLSMPIECAEVFSKTVAGGLP
GAGLFGPKNDLEDYDADSDFEVLMKTAHGHLVPDRVDKDKEATKPEFN
NHKDYAQEKPSRLKQRFLLRRTKPDYSTSHSARLTEDVLADDRDDYDFL
MQTS

TABLE 7

Naturally occurring C-terminal flanking regions of ITIM.*ITSM intracellular domains varying in length from 1-2890 (Table 7 comprises SEQ ID No 806 to SEQ ID No 836)

V

SRP

RTQ

| | |
|---|---|
| KIHK | SEQ ID No 806 |
| KTSK | SEQ ID No 807 |
| KIHR | SEQ ID No 808 |
| CVRS | SEQ ID No 809 |
| QYSK | SEQ ID No 810 |
| LFEENKL | SEQ ID No 811 |
| KAENIIMMETAQTSL | SEQ ID No 812 |
| YVISEEKDECVIATEV | SEQ ID No 813 |
| NHSKESKPTFSRATALDNV | SEQ ID No 814 |
| RKAVPDAVESRYSRTEGSLDGT | SEQ ID No 815 |
| KIHTGQPLRGPGFGLQLEREMSGMVPK | SEQ ID No 816 |
| VFPSGMGTSSPARRGSADGPRSAQPLRPEDGHCSWPL | SEQ ID No 817 |
| QTSPQPASEDTLTYADLDMVHLNRTPKQPAPKPEPSFSEYASVQVPRK | SEQ ID No 818 |
| YSYQPRTNSLSFPKQIAWNQSRTNSIISSQIPLGDNAKENERKTSDEVYD EDPFAYSEPL | SEQ ID No 819 |
| MKRLIKRYVLKAQVDKENDEVNEGELKEIKQDISSLRYELLEDKSQATEE LAILIHKLSEKLNPSMLRCE | SEQ ID No 820 |

TABLE 7-continued

Naturally occurring C-terminal flanking regions of
ITIM.*ITSM intracellular domains varying in length from 1-2890
(Table 7 comprises SEQ ID No 806 to SEQ ID No 836)

| | |
|---|---|
| IRQPVGRIFFAGTETATKWSGYMEGAVEAGERAAREVLNGLGKVTEKDI<br>WVQEPESKDVPAVEITHTFWERNLPS | SEQ ID No 821 |
| LRQPVDRIYFAGTETATHWSGYMEGAVEAGERAAREILHAMGKIPEDEI<br>WQSEPESVDVPAQPITTTFLERHLPSV | SEQ ID No 822 |
| MKRLIKRYVLKAQVDRENDEVNEGELKEIKQDISSLRYELLEEKSQATGE<br>LADLIQQLSEKFGKNLNKDHLRVNKGKDI | SEQ ID No 823 |
| LFYRRRNSPVERPPRAGHSEHHPDLGPAAEAAASQASRIWQELEAEEE<br>PVPEGSGPLGPWGPQDWVGPLPRGPTTPDEGCLRY | SEQ ID No 824 |
| LRFQASEEESWAAPPPVSQPPPCNRLPPELFEQLRMLLEPNSITGNDW<br>RRLASHLGLCGMKIRFLSCQRSPAAAILELFEEQNGSLQELHYLMTVME<br>RLDCASAIQNYLSGTHGGSPGPERGGARDNQGLELDEKL | SEQ ID No 825 |
| ENSEIYDYLRQGNRLKQPADCLDGLYALMSRCWELNPQDRPSFTELRE<br>DLENTLKALPPAQEPDEILYVNMDEGGGYPEPPGAAGGADPPTQPDPK<br>DSCSCLTAAEVHPAGRYVLCPSTTPSPAQPADRGSPAAPGQEDGA | SEQ ID No 826 |
| TRWRRNEDGAICRKSIKKMLEVLVVKLPLSEHWALPGGSREPGEMLPR<br>KLKRILRQEHWPSFENLLKCGMEVYKGYMDDPRNTDNAWIETVAVSVH<br>FQDQNDVELNRLNSNLHACDSGASIRWQVVDRRIPLYANHKTLLQKAAA<br>EFGAHY | SEQ ID No 827 |
| WSFGVVLWEIATLAEQPYQGLSNEQVLRFVMEGGLLDKPDNCPDMLFE<br>LMRMCWQYNPKMRPSFLEIISSIKEEMEPGFREVSFYYSEENKLPEPEE<br>LDLEPENMESVPLDPSASSSSLPLPDRHSGHKAENGPGPGVLVLRASFD<br>ERQPYAHMNGGRKNERALPLPQSSTC | SEQ ID No 828 |
| KSGYRMAKPDHATSEVYEIMVKCWNSEPEKRPSFYHLSEIVENLLPGQY<br>KKSYEKIHLDFLKSDHPAVARMRVDSDNAYIGVTYKNEEDKLKDWEGGL<br>DEQRLSADSGYIIPLPDIDPVPEEEDLGKRNRHSSQTSEESAIETGSSSS<br>TFIKREDETIEDIDMMDDIGIDSSDLVEDSFL | SEQ ID No 829 |
| QNHEMYDYLLHGHRLKQPEDCLDELYEIMYSCWRTDPLDRPTFSVLRL<br>QLEKLLESLPDVRNQADVIYVNTQLLESSEGLAQGSTLAPLDLNIDPDSII<br>ASCTPRAAISVVTAEVHDSKPHEGRYILNGGSEEWEDLTSAPSAAVTAE<br>KNSVLPGERLVRNGVSWSHSSMLPLGSSLPDELLFADDSSEGSEVLM | SEQ ID No 830 |
| CETLQFLDCICGSTTGGLGLLGLYINEKNVALINQTLESLTEYCQGPCHE<br>NQNCIATHESNGIDIITALILNDINPLGKKRMDLVLELKNNASKLLLAIMESR<br>HDSENAERILYNMRPKELVEVIKKAYMQGEVEFEDGENGEDGAASPRN<br>VGHNIYILAHQLARHNKELQSMLKPGGQVDGDEALEFYAKHTAQIEIVRL<br>DRTMEQIVFPVPSICEFLTKESKLRIYYTTERDEQGSKINDFFLRSEDLFN<br>EMNWQKKLRAQPVLYWCARNMS | SEQ ID No 831 |
| CETLQFLDCICGSTTGGLGLLGLYINEKNVALVNQNLESLTEYCQGPCHE<br>NQTCIATHESNGIDIIIALILNDINPLGKYRMDLVLQLKNNASKLLLAIMESR<br>HDSENAERILFNMRPRELVDVMKNAYNQGLECDHGDDEGGDDGVSPK<br>DVGHNIYILAHQLARHNKLLQQMLKPGSDPDEGDEALKYYANHTAQIEIV<br>RHDRTMEQIVFPVPNICEYLTRESKCRVFNTTERDEQGSKVNDFFQQTE<br>DLYNEMKWQKKIRNNPALFWFSRHIS | SEQ ID No 832 |
| NNSTVSRTSASKYENMIRYTGSPDSLRSRTPMITPDLESGVKMWHLVKN<br>HEHGDQKEGDRGSKMVSEIYLTRLLATKGTLQKFVDDLFETIFSTAHRG<br>SALPLAIKYMFDFLDEQADKHGIHDPHVRHTWKSNCLPLRFWVNMIKNP<br>QFVFDIHKNSITDACLSVVAQTFMDSCSTSEHRLGKDSPSNKLLYAKDIP<br>SYKNWVERYYSDIGKMPAISDQDMNAYLAEQSRMHMNEFNTMSALSEI<br>FSYVGKYSEEILGPLDHDDQCGKQKLAYKLEQVITLMSLDS | SEQ ID No 833 |
| CETLQFLDIMCGSTTGGLGLLGLYINEDNVGLVIQTLETLTEYCQGPCHE<br>NQTCIVTHESNGIDIITALILNDISPLCKYRMDLVLQLKDNASKLLLALMES<br>RHDSENAERILISLRPQELVDVIKKAYLQEEERENSEVSPREVGHNIYILA<br>LQLSRHNKQLQHLLKPVKRIQEEEAEGISSMLSLNNKQLSQMLKSSAPA<br>QEEEEDPLAYYENHTSQIEIVRQDRSMEQIVFPVPGICQFLTEETKHRLF<br>TTTEQDEQGSKVSDFFQSSFLHNEMEWQRKLRSMPLIYWFSRRMT | SEQ ID No 834 |
| PYSQRPKAEDMDLEWRQGRMTRIILQDEDVTTKIECDWKRLNSLAHYQ<br>VTDGSLVALVPKQVSAYNMANSFTFTRSLSRYESLLRTASSPDSLRSRA<br>PMITPDQETGTKLWHLVKNHDHADHREGDRGSKMVSEIYLTRLLATKGT<br>LQKFVDDLFETVFSTAHRGSALPLAIKYMFDFLDEQADRQISDPDVRHT<br>WKSNCLPLRFWVNVIKNPQFVFDIHKNSITDACLSVVAQTFMDSCSTSE<br>HRLGKDSPSNKLLYAKDIPNYKSWVERYYRDIAKMASISDQDMDAYLVE<br>QSRLHASDFSVLSALNELYFYVTKYRQEILTALDRDASCRKHKLRQKLEQ<br>IISLVSSDS | SEQ ID No 835 |

TABLE 7-continued

Naturally occurring C-terminal flanking regions of ITIM.*ITSM intracellular domains varying in length from 1-2890 (Table 7 comprises SEQ ID No 806 to SEQ ID No 836)

| | |
|---|---|
| DLSNKINEMKTFNSPNLKDGRFVNPSGQPTPYATTQLIQSNLSNNMNNG SGDSGEKHWKPLGQQKQEVAPVQYNIVEQNKLNKDYRANDTVPPTIPY NQSYDQNTGGSYNSSDRGSSTSGSQGHKKGARTPKVPKQGGMNWAD LLPPPPAHPPPHSNSEEYNISVDESYDQEMPCPVPPARMYLQQDELEEE EDERGPTPPVRGAASSPAAVSYSHQSTATLTPSPQEELQPMLQDCPEE TGHMQHQPDRRRQPVSPPPPPRPISPPHTYGYISGPLVSDMDTDAPEE EEDEADMEVAKMQTRRLLLRGLEQTPASSVGDLESSVTGSMINGWGSA SEEDNISSGRSSVSSSDGSFFTDADFAQAVAAAAEYAGLKVARRQMQD AAGRRHFHASQCPRPTSPVSTDSNMSAAVMQKTRPAKKLKHQPGHLR RETYTDDLPPPPVPPPAIKSPTAQSKTQLEVRPVVVPKLPSMDARTDRS SDRKGSSYKGREVLDGRQVVDMRTNPGDPREAQEQQNDGKGRGNKA AKRDLPPAKTHLIQEDILPYCRPTFPTSNNPRDPSSSSSMSSRGSGSRQ REQANVGRRNIAEMQVLGGYERGEDNNEELEETES | SEQ ID No 836 |

TABLE 8

Examples of naturally occurring C-terminal flanking regions of ITSM only intracellular domains that could vary in length from 1-2890 (Table 8 comprises SEQ ID No 837 to SEQ ID No 925)

| | |
|---|---|
| L | |
| V | |
| PR | |
| RIN | |
| RTQ | |
| SRP | |
| KIHK | SEQ ID No 837 |
| KTSK | SEQ ID No 838 |
| KIHR | SEQ ID No 839 |
| CVRS | SEQ ID No 840 |
| QYSK | SEQ ID No 841 |
| HYTQQ | SEQ ID No 842 |
| LGPKPQG | SEQ ID No 843 |
| LFEENKL | SEQ ID No 844 |
| VKADTYCA | SEQ ID No 845 |
| QTSEPSGT | SEQ ID No 846 |
| QSCALPTDAL | SEQ ID No 847 |
| AKNALLRWRV | SEQ ID No 848 |
| SKNRLLSIKT | SEQ ID No 849 |
| QHIPAQQQDHPE | SEQ ID No 850 |
| AHHRFYTKRLTFWT | SEQ ID No 851 |
| AHHRFYAKRMTLWT | SEQ ID No 852 |
| KHRHWYPFNFVIEQ | SEQ ID No 853 |
| AHHRFYAERLAGWPC | SEQ ID No 854 |
| KAENIIMMETAQTSL | SEQ ID No 855 |
| YVISEEKDECVIATEV | SEQ ID No 856 |

TABLE 8-continued

Examples of naturally occurring C-terminal flanking regions of ITSM only intracellular domains that could vary in length from 1-2890 (Table 8 comprises SEQ ID No 837 to SEQ ID No 925)

| Sequence | SEQ ID |
|---|---|
| RKAVPDAVESRYSRTEGSLDGT | SEQ ID No 857 |
| RKPQVVPPPQQNDLEIPESPTYENFT | SEQ ID No 2028 |
| GKSQPKAQNPARLSRKELENFDVYS | SEQ ID No 2029 |
| KIHTGQPLRGPGFGLQLEREMSGMVPK | SEQ ID No 858 |
| IYAGFDTKIMKNCGKIHLKRTKLDLLMNKL | SEQ ID No 859 |
| ASALKSHRTRGHGRGDCCGRSLGDSCCFSAK | SEQ ID No 860 |
| FTLVLEEIRQGFFTDEDTHLVKKFTLYVGDNWNKCD | SEQ ID No 861 |
| VFPSGMGTSSPARRGSADGPRSAQPLRPEDGHCSWPL | SEQ ID No 862 |
| PSEDFERTPQSPTLPPAKVAAPNLSRMGAIPVMIPAQSKDGSIV | SEQ ID No 863 |
| LPEDGGPYTNSILFDSDDNIKWVCQDMGLGDSQDFRDYMESLQDQM | SEQ ID No 864 |
| QTSPQPASEDTLTYADLDMVHLNRTPKQPAPKPEPSFSEYASVQVPRK | SEQ ID No 865 |
| SYHASGHSVAYKPGGFKASTGFGSNTKNKKIYDGGARTEDEVQSYPSKHDYV | SEQ ID No 866 |
| QVGPGAAARWDLCIDQAVVFIEDAIQYRSINHRVDASSMWLYRRYYSNVCQR | SEQ ID No 867 |
| EGPRKGHLEEEEEDGEEGAETLAHFCPMELRGPEPLGSRPRQPNLIPWAAAGRRAAP | SEQ ID No 868 |
| QKPGPLQKKLDSFPAQDPCTTIYVAATEPVPESVQETNSITVYASVTLPES | SEQ ID No 869 |
| YSYQPRTNSLSFPKQIAWNQSRTNSIISSQIPLGDNAKENERKTSDEVYDEDPFAYSEPL | SEQ ID No 870 |
| DPFEMAAYLKDGYRIAQPINCPDELFAVMACCWALDPEERPKFQQLVQCLTEFHAALGAYV | SEQ ID No 871 |
| THSNRETEIWTPRENDTITIYSTINHSKESKPTFSRATALDNV | SEQ ID No 872 |
| MKRLIKRYVLKAQVDKENDEVNEGELKEIKQDISSLRYELLEDKSQATEELAILIHKLSEKLNPSMLRCE | SEQ ID No 873 |
| PPSHHQLTLPDPSHHGLHSTPDSPAKPEKNGHAKDHPKIAKIFEIQTMPNGKTRTSLKTMSRRKLSQQKEKKATQ | SEQ ID No 874 |
| IRQPVGRIFFAGTETATKWSGYMEGAVEAGERAAREVLNGLGKVTEKDIWVQEPESKDVPAVEITHTFWERNLPS | SEQ ID No 875 |
| FNLQGKTPVSQKEESSATIYCSIRKPQVVPPPQQNDLEIPESPTYENFT | SEQ ID No 876 |
| LRQPVDRIYFAGTETATHWSGYMEGAVEAGERAAREILHAMGKIPEDEIWQSEPESVDVPAQPITTTFLERHLPSV | SEQ ID No 877 |
| PHTNRTILKEDPANTVYSTVEIPKKMENPHSLLTMPDTPRLFAYENVI | SEQ ID No 878 |
| MKRLIKRYVLKAQVDRENDEVNEGELKEIKQDISSLRYELLEEKSQATGELADLIQQLSEKFGKNLNKDHLRVNKGKDI | SEQ ID No 879 |
| LFYRRRNSPVERPPRAGHSEHHPDLGPAAEAAASQASRIWQELEAEEEPVPEGSGPLGPWGPQDWVGPLPRGPTTPDEGCLRY | SEQ ID No 880 |
| ANLTASDVMNRVNLGYLQDEMNDHQNTLSYVLINPPPDTRLEPSDIVYLIRSDPLAHVASSQSRKSSCSHKLSSCNPETRDETQL | SEQ ID No 881 |
| MASRNTQPAESRIYDEILQSKVLPSKEEPVNTVYSEVQFADKMGKASTQDSKPPGTSSYEIVI | SEQ ID No 882 |
| ENVPPLRWKEFVRRLGLSDHEIDRLELQNGRCLREAQYSMLATWRRRTPRREATLELLGRVLRDMDLLGCLEDIEEALCGPAALPPAPSLLR | SEQ ID No 883 |
| LIGDFLRACFVRFCNYCWCWDLEYGYPSYTEFDISGNVLALIFNQGMIWMGSFFAPSLPGINILRLHTSMYFQCWAVMCCNVPEARVFKASRSNN | SEQ ID No 884 |

TABLE 8-continued

Examples of naturally occurring C-terminal flanking regions of ITSM only intracellular domains that could vary in length from 1-2890 (Table 8 comprises SEQ ID No 837 to SEQ ID No 925)

| Sequence | ID |
|---|---|
| ESTESQILVGIVQRAQLVQALQAEPPSRAPGHQQCLQDILARGCPTEPV TLTLFSETTLHQAQNLFKLLNLQSLFVTSRGRAVGCVSWVEMKKAISNLT NPPAPK | SEQ ID No 885 |
| AKTIKDVFHNHGIHATTIQPEFASVGSKSSVVPCELACRTQCALKQCCGT LPQAPSGKDAEKTPAVSISCLELSNNLEKKPRRTKAENIPAVVIEIKNMPN KQPESSL | SEQ ID No 886 |
| TPSSPLATLLQHENPSHFELVVFLSAMQEGTGEICQRRTSYLPSEIMLHH CFASLLTRGSKGEYQIKMENFDKTVPEFPTPLVSKSPNRTDLDIHINGQSI DNFQISETGLTE | SEQ ID No 887 |
| GGRTMLPIRWMPPESILYRKFTTESDVWSFGVVLWEIFTYGKQPWYQLS NTEAIDCITQGRELERPRACPPEVYAIMRGCWQREPQQRHSIKDVHARL QALAQAPPVYLDVLG | SEQ ID No 888 |
| GGHTMLPIRWMPPESIMYRKFTTESDVWSLGVVLWEIFTYGKQPWYQL SNNEVIECITQGRVLQRPRTCPQEVYELMLGCWQREPHMRKNIKGIHTL LQNLAKASPVYLDILG | SEQ ID No 889 |
| LNPPPSPATDPSLYNMDMFYSSNIPATARPYRPYIIRGMAPPTTPCSTDV CDSDYSASRWKASKYYLDLNSDSDPYPPPPTPHSQYLSAEDSCPPSPA TERSYFHLFPPPPSPCTDSS | SEQ ID No 890 |
| DHNSPFFHMAAETLLQQDFELVVFLDGTVESTSATCQVRTSYVPEEVLW GYRFAPIVSKTKEGKYRVDFHNFSKTVEVETPHCAMCLYNEKDVRARM KRGYDNPNFILSEVNETDDTKM | SEQ ID No 891 |
| DETSPLKDLPLRSGEGDFELVLILSGTVESTSATCQVRTSYLPEEILWGY EFTPAISLSASGKYIADFSLFDQVVKVASPSGLRDSTVRYGDPEKLKLEE SLREQAEKEGSALSVRISNV | SEQ ID No 892 |
| LRFQASEEESWAAPPPVSQPPPCNRLPPELFEQLRMLLEPNSITGNDW RRLASHLGLCGMKIRFLSCQRSPAAAILELFEEQNGSLQELHYLMTVME RLDCASAIQNYLSGTHGGSPGPERGGARDNQGLELDEKL | SEQ ID No 893 |
| TRWRRNEDGAICRKSIKKMLEVLVVKLPLSEHWALPGGSREPGEMLPR KLKRILRQEHWPSFENLLKCGMEVYKGYMDDPRNTDNAWIETVAVSVH FQDQNDVELNRLNSNLHACDSGASIRWQVVDRRIPLYANHKTLLQKAAA EFGAHY | SEQ ID No 894 |
| ENAEIYNYLIGGNRLKQPPECMEDVYDLMYQCWSADPKQRPSFTCLRM ELENILGQLSVLSASQDPLYINIERAEEPTAGGSLELPGRDQPYSGAGDG SGMGAVGGTPSDCRYILTPGGLAEQPGQAEHQPESPLNETQRLLLLQQ GLLPHSSC | SEQ ID No 895 |
| WSFGVVLWEIATLAEQPYQGLSNEQVLRFVMEGGLLDKPDNCPDMLFE LMRMCWQYNPKMRPSFLEIISSIKEEMEPGFREVSFYYSEENKLPEPEE LDLEPENMESVPLDPSASSSSLPLPDRHSGHKAENGPGPGVLVLRASFD ERQPYAHMNGGRKNERALPLPQSSTC | SEQ ID No 896 |
| KSGYRMAKPDHATSEVYEIMVKCWNSEPEKRPSFYHLSEIVENLLPGQY KKSYEKIHLDFLKSDHPAVARMRVDSDNAYIGVTYKNEEDKLKDWEGGL DEQRLSADSGYIIPLPDIDPVPEEEDLGKRNRHSSQTSEESAIETGSSSS TPFIKREDETIEDIDMMDDIGIDSSDLVEDSFL | SEQ ID No 897 |
| QNHEMYDYLLHGHRLKQPEDCLDELYEIMYSCWRTDPLDRPTFSVLRL QLEKLLESLPDVRNQADVIYVNTQLLESSEGLAQGSTLAPLDLNIDPDSII ASCTPRAAISVVTAEVHDSKPHEGRYILNGGSEEWEDLTSAPSAAVTAE KNSVLPGERLVRNGVSWSHSSMLPLGSSLPDELLFADDSSEGSEVLM | SEQ ID No 898 |
| PDPYKSSILSLIKFKENPHLIIMNVSDCIPDAIEVVSKPEGTKIQFLGTRKSL TETELTKPNYLYLLPTEKNHSGPGPCICFENLTYNQAASDSGSCGHVPV SPKAPSMLGLMTSPENVLKALEKNYMNSLGEIPAGETSLNYVSQLASPM FGDKDSLPTNPVEAPHCSEYKMQMAVSLRLALPPPTENSSLSSITLLDP GEHYC | SEQ ID No 899 |
| PNPENCKALQFQKSVCEGSSALKTLEMNPCTPNNVEVLETRSAFPKIED TEIISPVAERPEDRSDAEPENHVVVSYCPPIIEEEIPNPAADEAGGTAQVI YIDVQSMYQPQAKPEEEQENDPVGGAGYKPQMHLPINSTVEDIAAEEDL DKTAGYRPQANVNTWNLVSPDSPRSIDSNSEIVSFGSPCSINSRQFLIPP KDEDSPKSNGGGWSFTNFFQNKPND | SEQ ID No 900 |
| RDVKKGNLPPDYRISLIDIGLVIEYLMGGAYRCNYTRKRFRTLYHNLFGP KRPKALKLLGMEDDIPLRRGRKTTKKREEEVDIDLDDPEINHFPFPFHEL | SEQ ID No 901 |

TABLE 8-continued

Examples of naturally occurring C-terminal flanking regions of ITSM only intracellular domains that could vary in length from 1-2890 (Table 8 comprises SEQ ID No 837 to SEQ ID No 925)

| Sequence | ID |
|---|---|
| MVWAVLMKRQKMALFFWQHGEEAMAKALVACKLCKAMAHEASENDM VDDISQELNHNSRDFGQLAVELLDQSYKQDEQLAMKLLTYELKNWSNAT CLQLAVAAKHRDFIAHTCSQMLLTDMWMGRLRMRK | |
| KDLKTRRNHEQEQTFPGGGSTIYSMIQSQSSAPTSQEPAYTLYSLIQPSR KSGSRKRNHSPSFNSTIYEVIGKSQPKAQNPARLSRKELENFDVYS | SEQ ID No 902 |
| GNANAAKPDLDKVISLKEANVKLRANALIKRGSMYMQQQQPLLSTQDFN MAADIDPQNADVYHHRGQLKILLDQVEEAVADFDECIRLRPESALAQAQ KCFALYRQAYTGNNSSQIQAAMKGFEEVIKKFPRCAEGYALYAQALTDQ QQFGKADEMYDKCIDLEPDNATTYVHKGLLQLQWKQDLDRGLELISKAI EIDNKCDFAYETMGTIEVQRGNMEKAIDMFNKAINLAKSEMEMAHLYSLC DAAHAQTEVAKKYGLKPPTL | SEQ ID No 903 |
| ENEAPWVTDKRPPPDWPSKGKIQFNNYQVRYRPELDLVLRGITCDIGSM EKIGVVGRTGAGKSSLTNCLFRILEAAGGQIIIDGVDIASIGLHDLREKLTII PQDPILFSGSLRMNLDPFNNYSDEEIWKALELAHLKSFVASLQLGLSHEV TEAGGNLSIGQRQLLCLGRALLRKSKILVLDEATAAVDLETDNLIQTTIQN EFAHCTVITIAHRLHTIMDSDKVMVLDNGKIIECGSPEELLQIPGPFYFMA KEAGIENVNSTKF | SEQ ID No 904 |
| CETLQFLDCICGSTTGGLGLLGLYINEKNVALINQTLESLTEYCQGPCHE NQNCIATHESNGIDIITALILNDINPLGKKRMDLVLELKNNASKLLLAIMESR HDSENAERILYNMRPKELVEVIKKAYMQGEVEFEDGENGEDGAASPRN VGHNIYILAHQLARHNKELQSMLKPGGQVDGDEALEFYAKHTAQIEIVRL DRTMEQIVFPVPSICEFLTKESKLRIYYTTERDEQGSKINDFFLRSEDLFN EMNWQKKLRAQPVLYWCARNMS | SEQ ID No 905 |
| CETLQFLDCICGSTTGGLGLLGLYINEKNVALVNQNLESLTEYCQGPCHE NQTCIATHESNGIDIIIALILNDINPLGKYRMDLVLQLKNNASKLLLAIMESR HDSENAERILFNMRPRELVDVMKNAYNQGLECDHGDDEGGDDGVSPK DVGHNIYILAHQLARHNKLLQQMLKPGSDPDEGDEALKYYANHTAQIEIV RHDRTMEQIVFPVPNICEYLTRESKCRVFNTTERDEQGSKVNDFFQQTE DLYNEMKWQKKIRNNPALFWFSRHIS | SEQ ID No 906 |
| NNSTVSRTSASKYENMIRYTGSPDSLRSRTPMITPDLESGVKMWHLVKN HEHGDQKEGDRGSKMVSEIYLTRLLATKGTLQKFVDDLFETIFSTAHRG SALPLAIKYMFDFLDEQADKHGIHDPHVRHTWKSNCLPLRFWVNMIKNP QFVFDIHKNSITDACLSWAQTFMDSCSTSEHRLGKDSPSNKLLYAKDIP SYKNWVERYYSDIGKMPAISDQDMNAYLAEQSRMHMNEFNTMSALSEI FSYVGKYSEEILGPLDHDDQCGKQKLAYKLEQVITLMSLDS | SEQ ID No 907 |
| CETLQFLDIMCGSTTGGLGLLGLYINEDNVGLVIQTLETLTEYCQGPCHE NQTCIVTHESNGIDIITALILNDISPLCKYRMDLVLQLKDNASKLLLALMES RHDSENAERILISLRPQELVDVIKKAYLQEEERENSEVSPREVGHNIYILA LQLSRHNKQLQHLLKPVKRIQEEEAEGISSMLSLNNKQLSQMLKSSAPA QEEEEDPLAYYENHTSQIEIVRQDRSMEQIVFPVPGICQFLTEETKHRLF TTTEQDEQGSKVSDFFDQSSFLHNEMEWQRKLRSMPLIYWFSRRMT | SEQ ID No 908 |
| LADGSFVRCTPSENSDLFYAVPWSCGTLGFLVAAEIRIIPAKKYVKLRFEP VRGLEAICAKFTHESQRQENHFVEGLLYSLDEAVIMTGVMTDEAEPSKL NSIGNYYKPWFFKHVENYLKTNREGLEYIPLRHYYHRHTRSIFWELQDIIP FGNNPIFRYLFGWMVPPKISLLKLTQGETLRKLYEQHHVVQDMLVPMKC LQQALHTFQNDIHVYPIWLCPFILPSQPGLVHPKGNEAELYIDIGAYGEPR VKHFEARSCMRQLEKFVRSVHGFQMLYADCYMNREEFWEMFDGSLYH KLREKLGCQDAFPEVYDKICKAARH | SEQ ID No 909 |
| NPEYFSASDMYVPDEWEVPREQISIIRELGQGSFGMVYEGLARGLEAGE ESTPVALKTVNELASPRECIEFLKEASVMKAFKCHHWRLLGVVSQGQP TLVIMELMTRGDLKSHLRSLRPEAENNPGLPQPALGEMIQMAGEIADGM AYLAANKFVHRDLAARNCMVSQDFTVKIGDFGMTRDVYETDYYRKGGK GLLPVRWMAPESLKDGIFTTHSDVWSFGVVLWEIVTLAEQPYQGLSNEQ VLKFVMDGGVLEELEGCPLQLQELMSRCWQPNPRLRPSFTHILDSIQEE LRPSFRLLSFYYSPECRGARGSLPTTDAEPDSSPTPRDCSPQNGGPGH | SEQ ID No 910 |
| PAPSALTPKILDLLVHAISINSAYTTKILPPEKEGALPRQVGNKTECALLGF VLDLKRDFQPVREQIPEDKLYKVYTFNSVRKSMSTVIRMPDGGFRLFSK GASEILLKKCTNILNSNGELRGFRPRDRDDMVRKIIEPMACDGLRTICIAY RDFSAGQEPDWDNENEVVGDLTCIAVVGIEDPVRPEVPEAIRKCQRAGI TVRMVTGDNINTARAIAAKCGIIQPGEDFLCLEGKEFNRRIRNEKGEIEQE RLDKVWPKLRVLARSSPTDKHTLVKGIIDSTTGEQRQVVAVTGDGTNDG PALKKADVGFAMGIAGTDVAKEASDIILTDDNFTSIVKAVMWGRNVYDSI | SEQ ID No 911 |
| GGDQLNCHFGSILHTTGLQYRDFIHVSFHDKVYELPFLVALDHRKESVVV AVRGTMSLQDVLTDLSAESEVLDVECEVQDRLAHKGISQAARYVYQRLI NDGILSQAFSIAPEYRLVIVGHSLGGGAAALLATMLRAAYPQVRCYAFSP | SEQ ID No 912 |

TABLE 8-continued

Examples of naturally occurring C-terminal flanking regions of ITSM only intracellular domains that could vary in length from 1-2890 (Table 8 comprises SEQ ID No 837 to SEQ ID No 925)

| Sequence | SEQ ID |
|---|---|
| PRGLWSKALQEYSQSFIVSLVLGKDVIPRLSVTNLEDLKRRILRVVAHCN KPKYKILLHGLWYELFGGNPNNLPTELDGGDQEVLTQPLLGEQSLLTRW SPAYSFSSDSPLDSSPKYPPLYPPGRIIHLQEEGASGRFGCCSAAHYSA KWSHEAEFSKILIGPKMLTDHMPDILMRALDSVVSDRAACVSCPAQGVS SVDVA | |
| PYSQRPKAEDMDLEWRQGRMTRIILQDEDVTTKIECDWKRLNSLAHYQ VTDGSLVALVPKQVSAYNMANSFTFTRSLSRYESLLRTASSPDSLRSRA PMITPDQETGTKLWHLVKNHDHADHREGDRGSKMVSEIYLTRLLATKGT LQKFVDDLFETVFSTAHRGSALPLAIKYMFDFLDEQADQRQISDPDVRHT WKSNCLPLRFWVNVIKNPQFVFDIHKNSITDACLSVVAQTFMDSCSTSE HRLGKDSPSNKLLYAKDIPNYKSWVERYYRDIAKMASISDQDMDAYLVE QSRLHASDFSVLSALNELYFYVTKYRQEILTALDRDASCRKHKLRQKLEQ IISLVSSDS | SEQ ID No 913 |
| KSDAAMTVAVKMLKPSAHLTEREALMSELKVLSYLGNHMNIVNLLGACTI GGPTLVITEYCCYGDLLNFLRRKRDSFICSKQEDHAEAALYKNLLHSKES SCSDSTNEYMDMKPGVSYVVPTKADKRRSVRIGSYIERDVTPAIMEDDE LALDLEDLLSFSYQVAKGMAFLASKNCIHRDLAARNILLTHGRITKICDFG LARDIKNDSNYVVKGNARLPVKWMAPESIFNCVYTFESDVWSYGIFLWE LFSLGSSPYPGMPVDSKFYKMIKEGFRMLSPEHAPAEMYDIMKTCWDA DPLKRPTFKQIVQLIEKQISESTNHIYSNLANCSPNRQKPVVDHSVRINSV GSTASSSQPLLVHDDV | SEQ ID No 914 |
| HVPKSYRRRRRHKRKTGHKEKKEKERISENYSDKSDIENADESSSSILKP LISPAAERIRFILGEEDDSPAPPQLFTELDELLAVDGQEMEWKETARWIK FEEKVEQGGERWSKPHVATLSLHSLFELRTCMEKGSIMLDREASSLPQL VEMIVDHQIETGLLKPELKDKVTYTLLRKHRHQTKKSNLRSLADIGKTVSS ASRMFTNPDNGSPAMTHRNLTSSSLNDISDKPEKDQLKNKFMKKLPRD AEASNVLVGEVDFLDTPFIAFVRLQQAVMLGALTEVPVPTRFLFILLGPKG KAKSYHEIGRAIATLMSDEVFHDIAYKAKDRHDLIAGIDEFLDEVIVLPPGE WDPAIRIEPPKSLPSSDKRKNMYSGGENVQMNGDTPHDGGHGGGHG DCEELQRTGRFCGGLIKDIKRKAPFFASDFYDALNIQ | SEQ ID No 915 |
| WIPDGENVKIPVAIKVLRENTSPKANKEILDEAYVMAGVGSPYVSRLLGIC LTSTVQLVTQLMPYGCLLDHVRENRGRLGSQDLLNWCMQIAKGMSYLE DVRLVHRDLAARNVLVKSPNHVKITDFGLARLLDIDETEYHADGGKVPIK WMALESILRRRFTHQSDVWSYGVTVWELMTFGAKPYDGIPAREIPDLLE KGERLPQPPICTIDVYMIMVKCWMIDSECRPRFRELVSEFSRMARDPQR FVVIQNEDLGPASPLDSTFYRSLLEDDDMGDLVDAEEYLVPQQGFFCPD PAPGAGGMVHHRHRSSSTRSGGGDLTLGLEPSEEEAPRSPLAPSEGA GSDVFDGDLGMGAAKGLQSLPTHDPSPLQRYSEDPTVPLPSETDGYVA PLTCSPQPEYVNQPDVRPQPPSPREGPLPAARPAGATLERPKTLSPGK NGVVKDVFAFGGAVENPEYLTPQGGAAPQPHPPPAFSPAFDNLYYWD QDPPERGAPPSTFKGTPTAENPEYLGLDVPV | SEQ ID No 916 |
| IMDPDEVPLDEQCERLPYDASKWEFARERLKLGKSLGRGAFGKVVQAS AFGIKKSPTCRTVAVKMLKEGATASEYKALMTELKILTHIGHHLNVVNLLG ACTKQGGPLMVIVEYCKYGNLSNYLKSKRDLFFLNKDAALHMEPKKEKM EPGLEQGKKPRLDSVTSSESFASSGFQEDKSLSDVEEEEDSDGFYKEPI TMEDLISYSFQVARGMEFLSSRKCIHRDLAARNILLSENNVVKICDFGLAR DIYKNPDYVRKGDTRLPLKWMAPESIFDKIYSTKSDVWSYGVLLWEIFSL GGSPYPGVQMDEDFCSRLREGMRMRAPEYSTPEIYQIMLDCWHRDPK ERPRFAELVEKLGDLLQANVQQDGKDYIPINAILTGNSGFTYSTPAFSED FFKESISAPKFNSGSSDDVRYVNAFKFMSLERIKTFEELLPNATSMFDDY QGDSSTLLASPMLKRFTWTDSKPKASLKIDLRVTSKSKESGLSDVSRPS FCHSSCGHVSEGKRRFTYDHAELERKIACCSPPPDYNSVVLYSTPPI | SEQ ID No 917 |
| IMDPGEVPLEEQCEYLSYDASQWEFPRERLHLGRVLGYGAFGKVVEAS AFGIHKGSSCDTVAVKMLKEGATASEHRALMSELKILIHIGNHLNVVNLLG ACTKPQGPLMVIVEFCKYGNLSNFLRAKRDAFSPCAEKSPEQRGRFRA MVELARLDRRRPGSSDRVLFARFSKTEGGARRASPDQEAEDLWLSPLT MEDLVCYSFQVARGMEFLASRKCIHRDLAARNILLSESDVVKICDFGLAR DIYKDPDYVRKGSARLPLKWMAPESIFDKVYTTQSDVWSFGVLLWEIFS LGASPYPGVQINEEFCQRLRDGTRMRAPELATPAIRRIMLNCWSGDPKA RPAFSELVEILGDLLQGRGLQEEEEVCMAPRSSQSSEEGSFSQVSTMAL HIAQADAEDSPPSLQRHSLAARYYNWVSFPGCLARGAETRGSSRMKTF EEFPMTPTTYKGSVDNQTDSGMVLASEEFEQIESRHRQESGFSCKGPG QNVAVTRAHPDSQGRRRRPERGARGGQVFYNSEYGELSEPSEEDHCS PSARVTFFTDNSY | SEQ ID No 918 |
| VMDPDELPLDEHCERLPYDASKWEFPRDRLKLGKPLGRGAFGQVIEAD AFGIDKTATCRTVAVKMLKEGATHSEHRALMSELKILIHIGHHLNVVNLLG ACTKPGGPLMVIVEFCKFGNLSTYLRSKRNEFVPYKTKGARFRQGKDYV GAIPVDLKRRLDSITSSQSSASSGFVEEKSLSDVEEEEAPEDLYKDFLTL EHLICYSFQVAKGMEFLASRKCIHRDLAARNILLSEKNVVKICDFGLARDI | SEQ ID No 919 |

TABLE 8-continued

Examples of naturally occurring C-terminal flanking regions of ITSM only intracellular domains that could vary in length from 1-2890 (Table 8 comprises SEQ ID No 837 to SEQ ID No 925)

| | |
|---|---|
| YKDPDYVRKGDARLPLKWMAPETIFDRVYTIQSDVWSFGVLLWEIFSLG ASPYPGVKIDEEFCRRLKEGTRMRAPDYTTPEMYQTMLDCWHGEPSQ RPTFSELVEHLGNLLQANAQQDGKDYIVLPISETLSMEEDSGLSLPTSPV SCMEEEEVCDPKFHYDNTAGISQYLQNSKRKSRPVSVKTFEDIPLEEPE VKVIPDDNQTDSGMVLASEELKTLEDRTKLSPSFGGMVPSKSRESVASE GSNQTSGYQSGYHSDDTDTTVYSSEEAELLKLIEIGVQTGSTAQILQPDS GTTLSSPPV | |
| FEPTVERGELVVRYRVRKSYSRRTTEATLNSLGISEELKEKLRDVMVDR HKVALGKTLGEGEFGAVMEGQLNQDDSILKVAVKTMKIAICTRSELEDFL SEAVCMKEFDHPNVMRLIGVCFQGSERESFPAPVVILPFMKHGDLHSFL LYSRLGDQPVYLPTQMLVKFMADIASGMEYLSTKRFIHRDLAARNCMLN ENMSVCVADFGLSKKIYNGDYYRQGRIAKMPVKWIAIESLADRVYTSKS DVWSFGVTMWEIATRGQTPYPGVENSEIYDYLRQGNRLKQPADCLDGL YALMSRCWELNPQDRPSFTELREDLENTLKALPPAQEPDEILYVNMDEG GGYPEPPGAAGGADPPTQPDPKDSCSCLTAAEVHPAGRYVLCPSTTPS PAQPADRGSPAAPGQEDGA | SEQ ID No 920 |
| WVPEGETVKIPVAIKILNETTGPKANVEFMDEALIMASMDHPHLVRLLGV CLSPTIQLVTQLMPHGCLLEYVHEHKDNIGSQLLLNWCVQIAKGMMYLE ERRLVHRDLAARNVLVKSPNHVKITDFGLARLLEGDEKEYNADGGKMPI KWMALECIHYRKFTHQSDVWSYGVTIWELMTFGGKPYDGIPTREIPDLL EKGERLPQPPICTIDVYMVMVKCWMIDADSRPKFKELAAEFSRMARDPQ RYLVIQGDDRMKLPSPNDSKFFQNLLDEEDLEDMMDAEEYLVPQAFNIP PPIYTSRARIDSNRSEIGHSPPPAYTPMSGNQFVYRDGGFAAEQGVSVP YRAPTSTIPEAPVAQGATAEIFDDSCCNGTLRKPVAPHVQEDSSTQRYS ADPTVFAPERSPRGELDEEGYMTPMRDKPKQEYLNPVEENPFVSRRKN GDLQALDNPEYHNASNGPPKAEDEYVNEPLYLNTFANTLGKAEYLKNNI LSMPEKAKKAFDNPDYWNHSLPPRSTLQHPDYLQEYSTKYFYKQNGRI RPIVAENPEYLSEFSLKPGTVLPPPPYRHRNTVV | SEQ ID No 921 |
| DLSNKINEMKTFNSPNLKDGRFVNPSGQPTPYATTQLIQSNLSNNMNNG SGDSGEKHWKPLGQQKQEVAPVQYNIVEQNKLNKDYRANDTVPPTIPY NQSYDQNTGGSYNSSDRGSSTSGSQGHKKGARTPKVPKQGGMNWAD LLPPPPAHPPPHSNSEEYNISVDESYDQEMPCPVPPARMYLQQDELEEE EDERGPTPPVRGAASSPAAVSYSHQSTATLTPSPQEELQPMLQDCPEE TGHMQHQPDRRRQPVSPPPPPRPISPPHTYGYISGPLVSDMDTDAPEE EEDEADMEVAKMQTRRLLLRGLEQTPASSVGDLESSVTGSMINGWGSA SEEDNISSGRSSVSSSDGSFFTDADFAQAVAAAAEYAGLKVARRQMQD AAGRRHFHASQCPRPTSPVSTDSNMSAAVMQKTRPAKKLKHQPGHLR RETYTDDLPPPPVPPPAIKSPTAQSKTQLEVRPVVVPKLPSMDARTDRS SDRKGSSYKGREVLDGRQVVDMRTNPGDPREAQEQQNDGKGRGNKA AKRDLPPAKTHLIQEDILPYCRPTFPTSNNPRDPSSSSSMSSRGSGSRQ REQANVGRRNIAEMQVLGGYERGEDNNEELEETES | SEQ ID No 922 |
| EPQDGCHPGDSVERSVTCLPSASDENENQLDGDGHEHLTSSDSAMGK PQVSEQDSLNNNESCTLSCEVAAGENLQNTLCEASRDEQAFLGKDKKIP GKRSPRSKKGTAKKIPPGLFSGDIAPLMQEKVLSAVTYAVDDEEAAEVN ANEQPEAPKLVLQSLFSLIRGEVEQLDSRALPLCLHQIAESYFQEEDYEK AMKFIQLERLYHEQLLANLSAIQEQWETKWKTVQPHTVTALRNSEKGFN GEDFERLTKICATHQDPLLSKHKIAAVEKSQERKCSTQLLVSEDPKEGGA TTKESESKTCLGTESSKESQHTVEPLGSSPCCHQMDVQTDSPSLSVTA GKDHMEELLCSAEATLALHTQSSETAGSPSGPDSSEDACEDDSRLQLA QTEACQDVARIEGIAEDPKVFLSSKSKTEPLISPGCDRIPPALISEGKYSQ AQRKELRLPLRDASEALPTDQLENNELNELQQPDLTDSDGKSPQAQAD SDGSENVLCGNNQISDLGILLPEVCMAPEEKGDKDDQLNKETEDYLNSL LEGCLKDTEDSLSYEDNQDDDSDLLQDLSPEEASYSLQENLPSDESCLS LDDLAKRIEIAEVVPTEGLVSILKKRNDTVGDHPAQMQHKPSKRRVRFQE IDDSLDQDEVGGGS | SEQ ID No 923 |
| SKNIPTTKDVEPLLEIDGDIRNFEVFLSSRTPVLVARDVKVFLPCTVNLDP KLREIIADVRAAREQISIGGLAYPPLPLHEGPPRAPSGYSQPPSVCSSTSF NGPFAGGVVSPQPHSSYYSGMTGPQHPFYNRPFFAPYLYTPRYYPGG SQHLISRPSVKTSLPRDQNNGLEVIKEDAAEGLSSPTDSSRGSGPAPGP VVLLNSLNVDAVCEKLKQIEGLDQSMLPQYCTTIKKANINGRVLAQCNID ELKKEMNMNFGDWHLFRSTVLEMRNAESHVVPEDPRFLSESSSGPAPH GEPARRASHNELPHTELSSQTPYTLNFSFEELNTLGLDEGAPRHSNLSW QSQTRRTPSLSSLNSQDSSIEISKLTDKVQAEYRDAYREYIAQMSQLEG GPGSTTISGRSSPHSTYYMGQSSSGGSIHSNLEQEKGKDSEPKPDDGR KSFLMKRGDVIDYSSSGVSTNDASPLDPITEEDEKSDQSGSKLLPGKKS SERSSLFQTDLKLKGSGLRYQKLPSDEDESGTEESDNTPLLKDDKDRKA EGKVERVPKSPEHSAEPIRTFIKAKEYLSDALLDKKDSSDSGVRSSESSP NHSLHNEVADDSQLEKANLIELEDDSHSGKRGIPHSLSGLQDPIIARMSIC SEDKKSPSECSLIASSPEENWPACQKAYNLNRTPSTVTLNNNSAPANRA NQNFDEMEGIRETSQVILRPSSPNPTTIQNENLKSMTHKRSQRSSYTR LSKDPPELHAAASSESTGFGEERESIL | SEQ ID No 924 |

TABLE 8-continued

Examples of naturally occurring C-terminal flanking regions
of ITSM only intracellular domains that could vary in length from
1-2890 (Table 8 comprises SEQ ID No 837 to SEQ ID No 925)

| | |
|---|---|
| WSLGVTLWELFDNAAQPYSNLSNLDVLNQVIRERDTKLPKPQLEQPYSD<br>RWYEVLQFCWLSPEKRPAAEDVHRLLTYLRLQSQRDSEVDFEQQWNA<br>LKPNTNSRDSSNNAAFPILDHFARDRLGREMEEVLTVTETSQGLSFEYV<br>WEAAKHDHFDERSRGHLDEGLSYTSIFYPVEVFESSLSDPGPGKQDDS<br>GQDVPLRVPGVVPVFDAHNLSVGSDYYIQLEEKSGSNLELDYPPALLTT<br>DMDNPERTGPELSQLTALRSVELEESSTDEDFFQSSTDPKDSSLPGDLH<br>VTSGPESPFNNIFNDVDKSEDLPSHQKIFDLMELNGVQADFKPATLSSSL<br>DNPKESVITGHFEKEKPRKIFDSEPLCLSDNLMHQDNFDPLNVQELSENF<br>LFLQEKNLLKGSLSSKEHINDLQTELKNAGFTEAMLETSCRNSLDTELQF<br>AENKPGLSLLQENVSTKGDDTDVMLTGDTLSTSLQSSPEVQVPPTSFET<br>EETPRRVPPDSLPTQGETQPTCLDVIVPEDCLHQDISPDAVTVPVEILST<br>DARTHSLDNRSQDSPGESEETLRLTESDSVLADDILASRVSVGSSLPEL<br>GQELHNKPFSEDHHSHRRLEKNLEAVETLNQLNSKDAAKEAGLVSALSS<br>DSTSQDSLLEDSLSAPFPASEPSLETPDSLESVDVHEALLDSLGSHTPQK<br>LVPPDKPADSGYETENLESPEWTLHPAPEGTADSEPATTGDGGHSGLP<br>PNPVIVISDAGDGHRGTEVTPETFTAGSQGSYRDSAYFSDNDSEPEKRS<br>EEVPGTSPSALVLVQEQPLPEPVLPEQSPAAQDSCLEARKSQPDESCLS<br>ALHNSSDLELRATPEPAQTGVPQQVHPTEDEASSPWSVLNAELSSGDD<br>FETQDDRPCTLASTGTNTNELLAYTNSALDKSLSSHSEGPKLKEPDIEGK<br>YLGKLGVSGMLDLSEDGMDADEEDENSDDSDEDLRAFNLHSLSSESED<br>ETEHPVPIILSNEDGRHLRSLLKPTAANAPDPLPEDWKKEKKAVTFFDDV<br>TVYLFDQETPTKELGPCGGEACGPDLSGPAPASGSPYLSRCINSESSTD<br>EEGGGFEWDDDFSPDPFMSKTTSNLLSSKPSLQTSKYFSPPPPARSTE<br>QSWPHSAPYSRFSISPANIASFSLTHLTDSDIEQGGSSEDGEKD | SEQ ID No 925 |

In some embodiments, variants of the sequence ((L1-ITIM-L2)$^n$-(L3-ITSM-L4)$^m$)$^p$ have at least 80%, 85%, 90%, 95%, 96%, 97%, 98%, 99% amino acid sequence identity with said sequence.

In some embodiments, variants of the sequence ((L1-ITIM-L2)$^n$-(L3-ITSM-L4)$^m$)$^p$ have at least 95% amino acid sequence identity with said sequence.

In some embodiments, variants of the sequence ((L1-ITIM-L2)$^n$-(L3-ITSM-L4)$^m$)$^p$ have at least 99% amino acid sequence identity with said sequence.

In some embodiments, variants of the sequence ((L1-ITIM-L2)$^n$-(L3-ITSM-L4)$^m$)$^p$ have substantially the same activity as the non-variant sequence. In some embodiments, substantially the same activity refers to at least 80%, 85%, 90%, 95% of the activity of the non-variant sequence.

In some embodiments, substantially the same activity refers to at least 80%, 85%, 90%, 95% of the activity of the non-variant sequence as measured by monitoring the luciferase activity in reporter cells comprising a P-CAR and an N-CAR comprising the intracellular domain to be tested and incorporating inducible NFAT- or NfkB-regulated luciferase expression, such as for example as disclosed in Example 3 below.

Transmembrane Domain of the N-CAR

With respect to the transmembrane domain, in various embodiments, a N-CAR can be designed to comprise a transmembrane domain that is attached to the extracellular domain of the N-CAR. A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 up to 15 amino acids of the intracellular region). In one aspect, the transmembrane domain is one that is associated with one of the other domains of the N-CAR. In some instances, the transmembrane domain can be selected or modified by amino acid substitution to avoid binding of such domains to the transmembrane domains of the same or different surface membrane proteins, e.g., to minimize interactions with other members of the receptor complex. In one aspect, the transmembrane domain is capable of homodimerization with another CAR on the CAR T-cell surface. In a different aspect the amino acid sequence of the transmembrane domain may be modified or substituted so as to minimize interactions with the binding domains of the native binding partner present in the same CAR T-Cell.

The transmembrane domain may be derived either from a natural or from a recombinant source. Where the source is natural, the domain may be derived from any membrane-bound or transmembrane protein. In one aspect the transmembrane domain is capable of signaling to the intracellular domain(s) whenever the N-CAR has bound to a target. A transmembrane domain of particular use in this invention may include at least the transmembrane region(s) of e.g., the alpha, beta or zeta chain of the T-cell receptor, PD-1, 4-1BB, OX40, ICOS, CTLA-4, LAG3, 2B4, BTLA4, TIM-3, TIGIT, SIRPA, CD28, CD3 epsilon, CD45, CD4, CD5, CD8, CD9, CD16, CD22, CD33, CD37, CD64, CD80, CD86, CD134, CD137, CD154.

In some embodiment, the transmembrane domain of the N-CAR includes at least the transmembrane region(s) of PD-1 or CD28alpha.

In some embodiments, the transmembrane domain can be attached to the extracellular domain of the N-CAR, via a hinge, e.g., a hinge from a human protein. For example, in one embodiment, the hinge can be a human Ig (immunoglobulin) hinge, e.g., a PD-1 hinge, an IgG4 hinge, or a CD8alpha hinge.

In some embodiments, the transmembrane domain may be recombinant, in which case it will comprise predominantly hydrophobic residues such as leucine and valine. In one aspect a triplet of phenylalanine, tryptophan and valine can be found at each end of a recombinant transmembrane domain.

Optionally, a short oligo- or polypeptide linker, between 2 and 10 amino acids in length may form the linkage between the transmembrane domain and the cytoplasmic region of the N-CAR. A glycine-serine doublet provides a particularly suitable linker. For example, in one aspect, the linker comprises the amino acid sequence of GGGGSGGGGS (SEQ ID NO: 2042). In some embodiments, the linker is encoded by a nucleotide sequence of GGTGGCGGAGGTTCTGGAGGTGGAGGTTCC (SEQ ID NO: 2043).

Extracellular Domain of the N-CAR

The antigen binding domain can be any domain that binds to the off-tissue antigen including but not limited to a monoclonal antibody, a recombinant antibody, a human antibody, a humanized antibody, and a functional fragment thereof, including but not limited to a single-domain antibody such as a heavy chain variable domain (VH), a light chain variable domain (VL) and a variable domain (VHH) of camelid derived nanobody, and to an alternative scaffold known in the art to function as antigen binding domain, such as a recombinant fibronectin domain, and the like. In some instances, it is beneficial for the antigen binding domain to be derived from the same species in which the N-CAR will ultimately be used in. For example, for use in humans, it may be beneficial for the antigen binding domain of the N-CAR to comprise human or humanized residues for the antigen binding domain of an antibody or antibody fragment.

A humanized antibody can be produced using a variety of techniques known in the art, including but not limited to, CDR-grafting (see, e.g., European Patent No. EP 239,400; International Publication No. WO 91/09967; and U.S. Pat. Nos. 5,225,539, 5,530,101, and 5,585,089, each of which is incorporated herein in its entirety by reference), veneering or resurfacing (see, e.g., European Patent Nos. EP 592,106 and EP 519,596; Padlan, 1991, Molecular Immunology, 28(4/5):489-498; Studnicka et al., 1994, Protein Engineering, 7(6):805-814; and Roguska et al., 1994, PNAS, 91:969-973, each of which is incorporated herein by its entirety by reference), chain shuffling (see, e.g., U.S. Pat. No. 5,565,332, which is incorporated herein in its entirety by reference), and techniques disclosed in, e.g., U.S. Patent Application Publication No. US2005/0042664, U.S. Patent Application Publication No. US2005/0048617, U.S. Pat. Nos. 6,407,213, 5,766,886, International Publication No. WO 9317105, Tan et al., J. Immunol., 169: 1119-25 (2002), Caldas et al., Protein Eng., 13(5):353-60 (2000), Morea et al., Methods, 20(3):267-79 (2000), Baca et al., J. Biol. Chem., 272(16): 10678-84 (1997), Roguska et al., Protein Eng., 9(10):895-904 (1996), Couto et al., Cancer Res., 55 (23 Supp):5973s-5977s (1995), Couto et al., Cancer Res., 55(8): 1717-22 (1995), Sandhu J S, Gene, 150(2):409-10 (1994), and Pedersen et al., J. Mol. Biol., 235(3):959-73 (1994), each of which is incorporated herein in its entirety by reference. Often, framework residues in the framework regions will be substituted with the corresponding residue from the CDR donor antibody to alter, for example improve, antigen binding. These framework substitutions are identified by methods well-known in the art, e.g., by modeling of the interactions of the CDR and framework residues to identify framework residues important for antigen binding and sequence comparison to identify unusual framework residues at particular positions. (See, e.g., Queen et al., U.S. Pat. No. 5,585,089; and Riechmann et al., 1988, Nature, 332:323, which are incorporated herein by reference in their entireties).

In some aspects, the portion of an N-CAR that comprises an antibody fragment is humanized with retention of high affinity for the target antigen and other favorable biological properties. According to one aspect of the invention, humanized antibodies and antibody fragments are prepared by a process of analysis of the parental sequences and various conceptual humanized products using three-dimensional models of the parental and humanized sequences. Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, e.g., the analysis of residues that influence the ability of the candidate immunoglobulin to bind the target antigen. In this way, FR residues can be selected and combined from the recipient and import sequences so that the desired antibody or antibody fragment characteristic, such as increased affinity for the target antigen, is achieved. In general, the CDR residues are directly and most substantially involved in influencing antigen binding.

In some embodiments, the antibody binding domain is a fragment, e.g., a single chain variable fragment (scFv). In some embodiments, the antibody binding domain is a Fv, a Fab, a (Fab')2, or a bi-functional (e.g. bi-specific) hybrid antibody (e.g., Lanzavecchia et al., Eur. J. Immunol. 17, 105 (1987)). In some embodiments, the antigen binding domain of the N-CAR of the invention binds an off-tissue antigen with wild-type or enhanced affinity.

In some instances, scFvs can be prepared according to method known in the art (see, for example, Bird et al., (1988) Science 242:423-426 and Huston et al., (1988) Proc. Natl. Acad. Sci. USA 85:5879-5883). ScFv molecules can be produced by linking VH and VL regions together using flexible polypeptide linkers. The scFv molecules comprise a linker (e.g., a Ser-Gly linker) with an optimized length and/or amino acid composition. The linker length can greatly affect how the variable regions of a scFv fold and interact. In fact, if a short polypeptide linker is employed (e.g., between 5-10 amino acids) intrachain folding is prevented. Interchain folding is also required to bring the two variable regions together to form a functional epitope binding site. For examples of linker orientation and size see, e.g., Hollinger et al. 1993 Proc Natl Acad. Sci. U.S.A. 90:6444-6448, U.S. Patent Application Publication Nos. 2005/0100543, 2005/0175606, 2007/0014794, and PCT publication Nos. WO2006/020258 and WO2007/024715, is incorporated herein by reference.

An scFv can comprise a linker of at least 1, 2, 3, 4, 5, 6, 7, 8, 9, 10, 11, 12, 13, 14, 15, 16, 17, 18, 19, 20, 25, 30, 35, 40, 45, 50, or more amino acid residues between its VL and VH regions. The linker sequence may comprise any naturally occurring amino acid. In some embodiments, the linker sequence comprises amino acids glycine and serine. In another embodiment, the linker sequence comprises sets of glycine and serine repeats such as $(Gly_4Ser)_n$ (SEQ ID NO: 2031), where n is a positive integer equal to or greater than 1. In one embodiment, the linker can be $(Gly_4Ser)_4$ (SEQ ID NO: 2032) or $(Gly_4Ser)_3$ (SEQ ID NO: 2033). Variation in the linker length may retain or enhance activity, giving rise to superior efficacy in activity studies.

In a preferred embodiment, the antigen binding domain of the N-CAR comprises an scFv.

The off-tissue antigen recognized by the antigen binding domain of the N-CAR is preferably an antigen that is not present or present at low level on the tumour cells targeted by the P-CAR.

The below table provide examples of combinations of N-CAR and P-CAR antigens.

| P-CAR Antigen | N-CAR Antigen |
|---|---|
| CD33 | Antigens specifically expressed in dendritic cells and/or haematopoetic stem cells such as ITGAX, CD1E, CD34, CD1C, CD123, CD141 |
| FLT3 | Antigens specifically expressed in haematopoetic stem cells such as CD34 or specifically expressed in Brain cerebellum such as ZP2, GABRA6, CRTAM, GRM4, MDGA1 |
| MSLN | Antigens specifically expressed in lung such as SFTPC, ROS1, SLC6A4, AGTR2 |
| MUC16 | Antigens specifically expressed in salivary gland such as LRRC26, HTR3A, TMEM211, MRGPRX3 |
| MUC17 | Antigens specifically expressed in colon & small intestine such as MEP1B, TMIGD1, CEACAM20, ALPI |

N-CAR antigens could also include antigens that are independent of the antigen that the P-CAR is targeting and that are down-regulated in tumor of interest, but present in all normal tissues of concern. Examples of such antigens for pancreatic ductal adenocarcinoma are TMPRSS11B, CYP17A1 and ATP4B and examples of such antigens for kidney clear cell carcinoma are GP2, MUC21, CLCA4 and SLC27A6.

The present invention encompasses a recombinant DNA construct comprising sequences encoding an N-CAR as defined above, wherein the N-CAR comprises an extracellular domain such as an antibody fragment that binds specifically to an off-tumor antigen, and wherein the sequence of the extracellular domain is contiguous with and in the same reading frame as a nucleic acid sequence encoding a transmembrane domain and an intracellular domain. In some embodiments, an exemplary N-CAR construct comprises an optional leader sequence, an extracellular off-tissue antigen binding domain, a hinge, a transmembrane domain, and an intracellular inhibitory signaling domain.

The present invention includes retroviral and lentiviral vector constructs expressing an N-CAR that can be directly transduced into a cell.

The present invention also includes an RNA construct that can be directly transfected into a cell. A method for generating mRNA for use in transfection involves in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-2000 bases in length (SEQ ID NO: 2048). RNA so produced can efficiently transfect different kinds of cells. In one embodiment, the template includes sequences for the N-CAR. In an embodiment, an RNA N-CAR vector is transduced into a T-cell by electroporation.

In some embodiments, the invention relates to an isolated immune cell comprising an N-CAR as defined herein. In some embodiments, the invention further relates to immune cells comprising an N-CAR as defined herein and a P-CAR. In some embodiments, said immune cell is a T-cell. In some embodiments, said T-cell is a human T-cell.

The term "positive signaling Chimeric Antigen Receptor" or alternatively a "P-CAR" refers to a recombinant polypeptide construct comprising at least an extracellular domain comprising an antigen binding domain, a transmembrane domain and an intracellular domain (also referred to herein as a "cytoplasmic signaling domain" or "an intracellular signaling domain") comprising a functional signaling domain derived from a stimulatory molecule as defined below. In some embodiments, the stimulatory molecule is the zeta chain associated with the T-cell receptor complex. In some embodiments, the cytoplasmic signaling domain further comprises one or more functional signaling domains derived from at least one costimulatory molecule as defined below. In some embodiments, the costimulatory molecule is chosen from 4-1BB (i.e., CD137), CD27 and/or CD28. In some embodiments, the P-CAR comprises a chimeric fusion protein comprising an extracellular antigen recognition domain, a transmembrane domain and an intracellular signaling domain comprising a functional signaling domain derived from a stimulatory molecule. In some embodiments, the P-CAR comprises a chimeric fusion protein comprising an extracellular antigen recognition domain, a transmembrane domain and an intracellular signaling domain comprising a functional signaling domain derived from a co-stimulatory molecule and a functional signaling domain derived from a stimulatory molecule. In some embodiments, the P-CAR comprises a chimeric fusion protein comprising an extracellular antigen recognition domain, a transmembrane domain and an intracellular signaling domain comprising two functional signaling domains derived from one or more co-stimulatory molecule(s) and a functional signaling domain derived from a stimulatory molecule. In some embodiments, the P-CAR comprises a chimeric fusion protein comprising an extracellular antigen recognition domain, a transmembrane domain and an intracellular signaling domain comprising at least two functional signaling domains derived from one or more co-stimulatory molecule(s) and a functional signaling domain derived from a stimulatory molecule. In some embodiments the P-CAR comprises an optional leader sequence at the amino-terminus (N-ter) of the P-CAR fusion protein. In some embodiments, the P-CAR further comprises a leader sequence at the N-terminus of the extracellular antigen recognition domain, wherein the leader sequence is optionally cleaved from the antigen recognition domain (e.g., aa scFv) during cellular processing and localization of the P-CAR to the cellular membrane.

The extracellular portion of a P-CAR comprising an antibody or antibody fragment thereof may exist in a variety of forms where the antigen binding domain is expressed as part of a contiguous polypeptide chain including, for example, a single domain antibody fragment (sdAb), a single chain antibody (scFv) and a humanized antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, N.Y.; Houston et al, 1988, Proc. Natl. Acad. Sci. USA 85:5879-5883; Bird et al., 1988, Science 242:423-426).

The term "stimulatory molecule," refers to a molecule expressed by a T-cell that provides the positive cytoplasmic signaling sequence(s) that regulate positive activation of the TCR complex in a stimulatory way for at least some aspect of the T-cell signaling pathway. In some embodiments, the positive signal is initiated by, for instance, binding of a TCR/CD3 complex with an MHC molecule loaded with peptide, and which leads to mediation of a T-cell response, including, but not limited to, proliferation, activation, differentiation, and the like. A positive cytoplasmic signaling sequence (also referred to as a "positive signaling domain" or positive intracellular signaling domain) that acts in a stimulatory manner may contain a signaling motif which is known as immunoreceptor tyrosine-based activation motif or ITAM. Examples of an ITAM containing positive cytoplasmic signaling sequence includes, but is not limited to, those derived from TCR zeta (or CD3zeta), FcR gamma, FcR beta, CD3 gamma, CD3 delta, CD3 epsilon, CD5, CD22, CD79a, CD79b, CD278 (also known as "ICOS") and CD66d.

In some aspect, the intracellular signaling domain of the P-CAR can comprise a positive intracellular signaling domain. The positive intracellular signaling domain generates a signal that promotes an immune effector function of the P-CAR containing cell, e.g., a P-CAR T-cell. Examples of immune effector function, e.g., in a P-CAR T-cell, include cytolytic activity and helper activity, including the secretion of cytokines.

The term "costimulatory molecule" refers to the cognate binding partner on a T-cell that specifically binds with a costimulatory ligand, thereby mediating a costimulatory response by the T-cell, such as, but not limited to, proliferation. Costimulatory molecules are cell surface molecules other than antigen receptors or their ligands that are required for an efficient immune response. Costimulatory molecules include, but are not limited to an MHC class I molecule, BTLA and a Toll ligand receptor, as well as OX40, CD2, CD27, CD28, CDS, ICAM-1, LFA-1 (CD11a/CD18) and 4-1BB (CD137).

A costimulatory intracellular signaling domain can be the intracellular portion of a costimulatory molecule. A costimulatory molecule can be represented in the following protein families: TNF receptor proteins, Immunoglobulin-like proteins, cytokine receptors, integrins, signaling lymphocytic activation molecules (SLAM proteins), and activating NK cell receptors. Examples of such molecules include CD27, CD28, 4-1BB (CD137), OX40, GITR, CD30, CD40, ICOS, BAFFR, HVEM, lymphocyte function-associated antigen-1 (LFA-1), CD2, CD7, LIGHT, NKG2C, SLAMF7, NKp80, CD160, B7-H3, and a ligand that specifically binds with CD83, and the like.

P-CARs and immune cells comprising them have been extensively disclosed and can be prepared by the skilled person according to known methods. For example, methodologies to prepare P-CAR and cells comprising such P-CARs are disclosed in U.S. Pat. No. 7,446,190, WO2008/121420, U.S. Pat. No. 8,252,592, US20140024809, WO2012/079000, WO2014153270, WO2012/099973, WO2014/011988, WO2014/011987, WO2013/067492, WO2013/070468, WO2013/040557, WO2013/126712, WO2013/126729, WO 2013/126726, WO2013/126733, U.S. Pat. No. 8,399,645, US20130266551, US20140023674, WO2014039523, U.S. Pat. Nos. 7,514,537, 8,324,353, WO2010/025177, U.S. Pat. No. 7,446,179, WO2010/025177, WO2012/031744, WO2012/136231A1, WO2012/050374A2, WO2013074916, WO2009/091826A3, WO2013/176915 or WO/2013/059593 which are all incorporated herein in their entirety by reference. Immune cells comprising a P-CAR and a N-CAR can be prepared by the skilled person according to the methodologies disclosed in the above mentioned references. In a preferred embodiment, immune cells comprising a P-CAR and a N-CAR can be prepared by the skilled person according to the methodologies disclosed in WO2013/176915.

In some embodiments, the method of engineering T-cells of invention can comprise:
(a) modifying T-cells by inactivating at least:
A first gene expressing a target for an immunosuppressive agent, and
A second gene encoding a component of the T-cell receptor (TCR)
(b) Expanding said cells, optionally in presence of said immunosuppressive agent.

An immunosuppressive agent is an agent that suppresses immune function by one of several mechanisms of action. In other words, an immunosuppressive agent is a role played by a compound which is exhibited by a capability to diminish the extent and/or voracity of an immune response. As non-limiting example, an immunosuppressive agent can be a calcineurin inhibitor, a target of rapamycin, an interleukin-2 u-chain blocker, an inhibitor of inosine monophosphate dehydrogenase, an inhibitor of dihydrofolic acid reductase, a corticosteroid or an immunosuppressive antimetabolite.

In a particular embodiment, the genetic modification step of the method relies on the inactivation of one gene selected from the group consisting of CD52, GR, TCR alpha and TCR beta. In another embodiment, the genetic modification step of the method relies on the inactivation of two genes selected from the group consisting of CD52 and GR, CD52 and TCR alpha, CDR52 and TCR beta, GR and TCR alpha, GR and TCR beta, TCR alpha and TCR beta. In another embodiment, the genetic modification step of the method relies on the inactivation of more than two genes. The genetic modification is preferably operated ex-vivo.

In some embodiments, the method of engineering T-cells of invention can comprise
(a) Providing a T-cell, preferably from a cell culture or from a blood sample;
(b) Selecting a gene in said T-cell expressing a target for an immunosuppressive agent;
(c) Transforming said T cell with nucleic acid encoding a rare-cutting endonuclease able to selectively inactivate by DNA cleavage, preferably by double-strand break respectively: said gene encoding a target for said immunosuppressive agent, and at least one gene encoding a component of the T-cell receptor (TCR);
(d) Expressing said rare-cutting endonucleases into said T-cells;
(e) Sorting the transformed T-cells, which do not express TCR on their cell surface;
(f) Expanding said cells, optionally in presence of said immunosuppressive agent.

In some embodiment, the method to engineer cell of the invention further comprises one or more additional genomic modification step. By additional genomic modification step, can be intended the introduction into cells to engineer of one or more protein of interest. Said protein of interest can be a P-CAR and/or an N-CAR.

In some embodiment the P-CAR is a Multi-chain Chimeric Antigen Receptor particularly adapted to the production and expansion of engineered T-cells, the multi-chain CAR comprising at least two of the following components:
a) one polypeptide comprising the transmembrane domain of FcsRI alpha chain and an extracellular ligand-binding domain,
b) one polypeptide comprising a part of N- and C-terminal cytoplasmic tail and the transmembrane domain of FccRI beta chain and/or
c) two polypeptide s comprising each a part of intracytoplasmic tail and the transmembrane domain of FccRI gamma chain, whereby different polypeptides multimerize together spontaneously to form dimeric, trimeric or tetrameric CAR.

Figure 3:
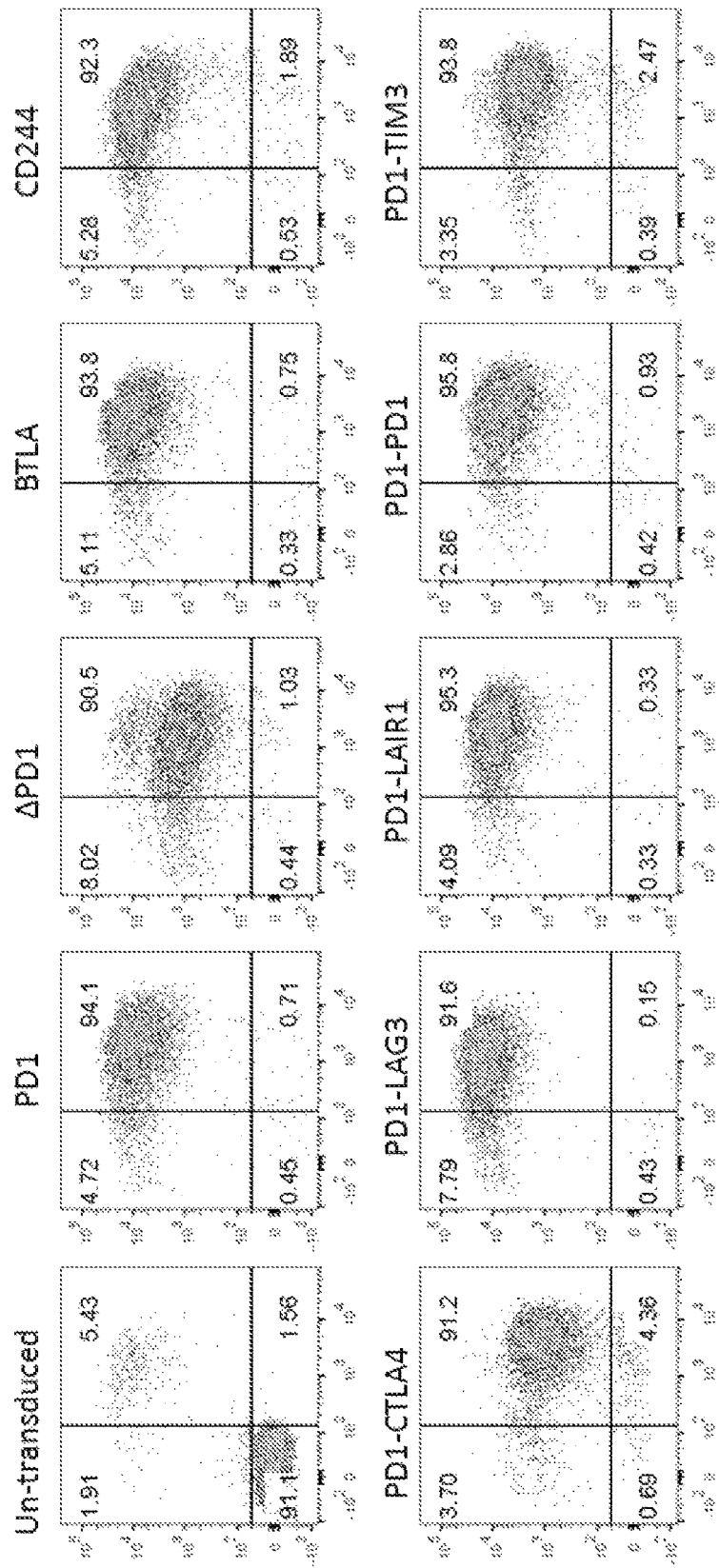
FIGS. 3 and 4 show the dual cell surface expression of P-CAR1 and various N-CARs assessed by multicolor flow cytometry in transduced NFkB-luciferase reporter Jurkat cells.
Figure 4:
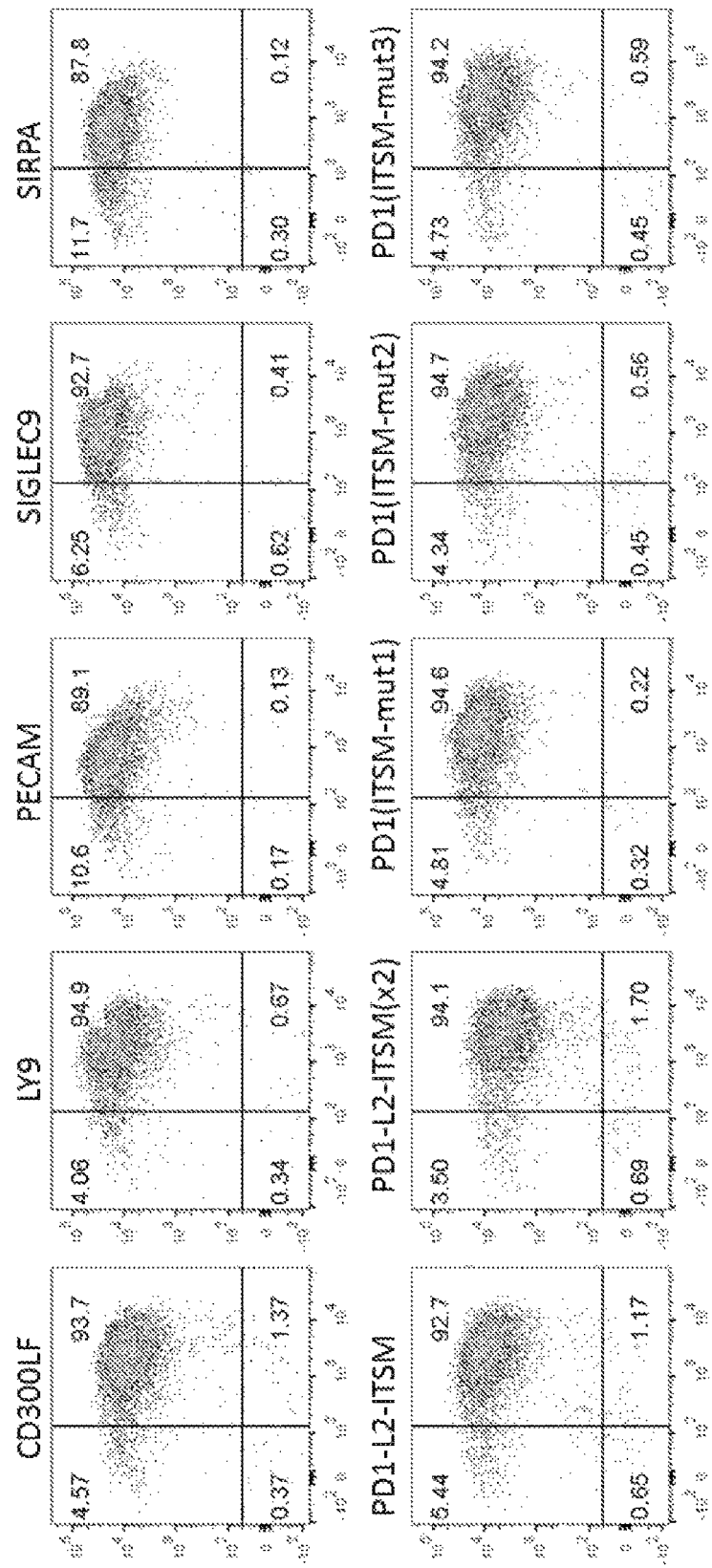

Example of tetrameric P-CARs are illustrated in FIG. 3 of WO2013176915 and different versions of multichain P-CARs are represented in FIG. 4 of WO2013176915. Such P-CAR can be expressed in a T-Cell obtained using the above disclosed method together with a N-CAR according to the present disclosure to obtain a T-cell according to the invention.

In some embodiment the invention relates to an immune cell comprising a N-CAR as defined herein and a P-CAR as defined in any of U.S. Pat. No. 7,446,190, WO2008/121420, U.S. Pat. No. 8,252,592, US20140024809, WO2012/079000, WO2014153270, WO2012/099973, WO2014/011988, WO2014/011987, WO2013/067492, WO2013/070468, WO2013/040557, WO2013/126712, WO2013/126729, WO 2013/126726, WO2013/126733, U.S. Pat. No. 8,399,645, US20130266551, US20140023674, WO2014039523, U.S. Pat. Nos. 7,514,537, 8,324,353, WO2010/025177, U.S. Pat. No. 7,446,179, WO2010/025177, WO2012/031744, WO2012/136231A1, WO2012/050374A2, WO2013074916, WO/2009/091826A3, WO2013/176915 or WO/2013/059593.

In some embodiments, the immune cell comprises an N-CAR as defined herein and a multi-chain P-CAR as defined in WO2014/039523.

In some embodiments, the immune cell of the invention is activated when the P-CAR antigen binding domain binds to its antigen. In some embodiments, such activation is reduced when the N-CAR antigen binding domain binds to its antigen. In some embodiments such reduction of activation is increased, preferably by at least 5%, 10%, 15%, 20% or 30% in an immune cell comprising an N-CAR according to the invention as compared to the same immune cell comprising an N-CAR comprising the full intracellular domain of PD-1. In some embodiments such reduction of activation is increased, preferably by at least 5%, 10%, 15%, 20% or 30% in an immune cell comprising an N-CAR according to the invention as compared to the same immune cell comprising an N-CAR comprising the full intracellular domain of CTLA-4.

In some embodiments, the activation is reduced by at least 5%, 10%, 15%, 20%, 25%, 30%, 35%, 40%, 45%, 50%, 55%, 60%, 65%, 70%, 75%, 80%, 85% when the N-CAR and P-CAR antigen binding domains both binds to their respective antigens as compared to when only the CAR antigen binding domain binds to its antigen.

In some embodiments, the level of activation of the immune cell is measured by determining cytokine production. In some embodiments, the level of activation of the immune cell is measured by monitoring IFNgamma production by ELISA and/or FACS and/or luminex assay. In some embodiments, the level of activation of the immune cell is measured by monitoring TNFalpha production by ELISA and/or luminex assay.

In some embodiments, the level of activation of the immune cell is measured by monitoring degranulation, for example by measuring CD107a levels by FACS.

In some embodiments, the level of activation of the immune cell is measured by monitoring the ability of the immune cell to kill target cells.

In some embodiments, the level of activation of the immune cell is measured by monitoring the luciferase activity in reporter cells incorporating inducible NFAT- or NfkB-regulated luciferase expression, such as for example as disclosed in Example 3 below.

In some embodiments, the negative signal of the N-CAR is short-termed and reversible to ensure that the immune cells comprising a P-CAR and an N-CAR according to the invention may be activated when it encounters only P-CAR antigen, despite prior inactivation in a off-tissue setting that has both P-CAR and N-CAR antigens.

Examples

Example 1—Identification of Inhibitory Domains to be Used in N-CARs

There are several receptors, i.e. CTLA-4, PD-1, BTLA, TIM-3, LAG3 that are known to provide a negative signal to attenuate or abrogate T-cell signaling. The intracellular signaling components of PD-1 were studied to identify motifs that may be responsible for its activity. PD-1 contains both an immunoreceptor tyrosine-based inhibitory motif (ITIM) and immunoreceptor tyrosine-based switch motif (ITSM) and data suggests that the ITSM domain plays a significant role in recruiting phosphatases (i.e. SHP2) that enable inactivation of upstream signaling components, like CD3zeta (see Riley J L., *Immunol Rev.* 2009 May; 229(1): 114-25; or Yokosuka T et al., *J Exp Med.* 2012 Jun. 4; 209(6):1201-17). Other receptors and molecules with ITSMs were identified and analyzed to help understand the functional role of this sequence motif with the intention to utilize it in providing a negative signal that attenuates or abrogates T-cell activation caused by engagement of the P-CAR. Protein sequences were downloaded from swissprot database restricting to sequences that were annotated as being cytoplasmic. Each of these cytoplasmic sequences was searched for the patterns of interest (ITIM motif, ITSM motif or ITIM and ITSM motif).

Example 2—Design of N-CARs

N-CARs comprising at least one ITSM, alone or in combination with one or more ITIMs or other inhibitory domain such as those of TIM-3, LAG-3 or CTLA4 are prepared in an effort to generate effective NOT gates.

In particular, the following N-CARs are prepared:
N-CARs comprising multiple tandems PD-1 ITIM-ITSM;
N-CARs comprising multiple tandems PD-1 ITSM;
N-CARs comprising single or multiple non-PD1 natural ITSM or ITIM-ITSM;
N-CARs comprising synthetic ITSM or ITIM-ITSM;
N-CARS comprising at least one ITSM and signaling domains from other inhibitory receptors such as TIM-3, LAG-3 or CTLA4.

Example 3—Activity of T-Cells Comprising a P-CAR and a N-CAR in Immortalized Human T-Cells An experimental model is used to test the N-CARs designed according to Example 2. The model consists of a positive signaling CAR (P-CAR) construct containing from the N-terminus, a signaling domain or secretory signal domain (e.g. CD8 secretory signal sequence), anti-CD-19 single-chain antibody, hinge (e.g. CD8alpha), transmembrane (e.g CD8alpha), and positive intracellular signaling domains (e.g. 41BB and CD3zeta). The P-CAR is followed by or preceded by a fluorescent marker (e.g. EGFP) or antibiotic resistance gene separated from the P-CAR by either a P2A or IRES (see for example Table 9).

This construct is constructed using standard molecular biology methods and transduced into T-cell receptor (TCR) negative or an NFAT- or NfkB-regulated luciferase reporter Jurkat cell-line. These cells are purified using bulk FACS sorting using the fluorescent marker or by selection in the appropriate antibiotic followed by flow cytometry to confirm surface CAR expression, and tested for activity against differentially expressing CD19 cell-lines to establish activation, proliferation, and cytokine release, and degranulation/cytotoxicity thresholds. Once an appropriate P-CAR cell line has been identified, these cells are transduced with a plasmid containing the negative signaling CAR (N-CAR) construct containing from the N-terminus, a signaling domain (e.g. CD8 secretory signal sequence), anti-PSMA single-chain antibody, hinge (e.g. truncated PD-1 extracellular domain), transmembrane (e.g. PD-1), and negative intracellular signaling domains to be evaluated (native or modified ITSMs optionally in combination with ITIMs or other inhibitory signaling domains) followed by or preceded by a fluorescent marker (e.g. mCherry) or antibiotic-resistance gene separated from the N-CAR by either a P2A or IRES. Multiple versions of these N-CAR constructs are constructed, using standard site-directed and cassette mutagenesis. The T-cells comprising a P-CAR and a N-CAR (also named P-CAR+/N-CAR+ T-cells or NOT GATE CAR T-Cells) are purified by bulk FACS sorting on both fluorescent markers (e.g. EGFP and mCherry) or by sequential selection in appropriate antibiotics followed by dual-color flow cytometry to detect surface expression of both CARs, and tested first for retention of P-CAR activity on CD19 expressing cells and then the potency of negative signal on cells expressing both CD19 and PSMA. The N-CAR candidates are characterized by their ability to attenuate positive signal from P-CAR on varying levels of both the P-CAR and N-CAR antigens by monitoring NFAT- or NfkB-regulated luciferase reporter activity, cytokine production (IFNgamma by ELISA/FACS), degranulation (CD107a levels) and killing of target cells (by FACS). Reversibility and the kinetics of reversibility of the N-CAR signal are tested by first incubating the P-CAR+/N-CAR+ T-cells with cells expressing both CD19 and PSMA, purifying them followed by incubation with CD19 cells. The cytokine production and cytotoxicity of these cells are compared to cells that were directly incubated with CD19 cells.

Experiment and Results

Jurkat cells (clone E6-1 ATCC #TIB-152) were maintained at a density of $0.4$–$2 \times 10^6$ cells/mL in RPMI 1640 (Life Technologies) containing 10% fetal bovine serum (hyclone), 1 mM sodium pyruvate, 1× glutaMAX, 1× nonessential amino acids (Mediatech), and 25 mM HEPES buffer. 293T cells (clone HEK-293T/17, ATCC CRL-11268) were maintained subconfluently in DMEM containing 4.5 g/L glucose, 10% fetal bovine serum, 1 mM sodium pyruvate, 1× glutaMAX, 1× nonessential amino acids, and 25 mM HEPES.

Lentiviral particles (LV) were produced by transient transfection of sub-confluent 293T cells in 6-well plates with a transfer vector (pLVX) encoding the CAR or protein of interest, an HIV-1 gag pol packaging plasmid (psPAX2), and a VSV-G expression plasmid (pMD2.G) at a 4:3:1 ratio, using Lipofectamine 2000 (Invitrogen). The following day the media was replaced, and 48 h after transfection the LV was harvested and filtered through a 0.45 um Millex-HV syringe filter (Millipore). Fresh LV supernatant was used immediately to transduce sub-confluent Jurkat or 293T cells by diluting LV sup in an equal volume of cell culture medium.

Artificial antigen-presenting cells (AAPCs) were prepared by sequential LV transduction of 293T cells. Subconfluent 293T cells were transfected with pLVX expression constructs encoding either codon-optimized full-length human CD19 (NP_001171569), full-length human PSMA (NP_004467), or empty vector. The pLVX vectors comprised a puromycin-resistance gene followed by a P2A sequence and the target antigen. Transduced 293 Ts were subsequently selected in puromycin-containing media, and maintained as pools of expressing clones. Surface antigen expression was determined by flow cytometry, using APC-conjugated goat F(ab')$_2$-anti-human PSMA (clone LN1-17, BioLegend cat #342504) or BV421-conjugated mouse-anti-human CD19 (clone H1B19, BD Biosciences cat #562440). Cells were sorted by FACS into populations of CD19 low-expressing or high-expressing clones, PSMA low-expressing or high-expressing clones, and dual CD19 low/PSMA high-expressers or dual CD19 high/PSMA high-expressers.

For determination of T cell activation, a luciferase reporter assay was established in Jurkat cells. Jurkat cells were transduced to stably express a firefly luciferase gene under the control of a minimal (m)CMV promoter and tandem repeats of either the NFκB or NFAT transcriptional response element (TRE) [(Qiagen Cignal Lentivirus]. Transcription factors recognizing these TREs play important roles in T cell signal transduction pathways and are integral in the transcriptional regulation of cytokine genes and other genes critical for the immune response. Upon T cell receptor activation, luciferase reporter activity is modulated and can be measured by quantitative luminometry.

Reporter Jurkat cells (either NFAT-Luc or NFkB-Luc) were subsequently transduced to stably express different combinations of P- and N-CARs. pLVX-CAR encoding constructs comprised an antibiotic resistance gene (puromycin resistance for P-CARS and blasticidin resistance for N-CARs) followed by a P2A sequence and the P- or N-CAR.

In particular, N-FAT-Luc and NFkB-Luc Jurkat cells expressing P-CAR1 or P-CAR2 and an N-CAR comprising an intracellular domain selected from the sequences listed in Table 10 were prepared.

P-CAR1 comprises a ScFv from anti-CD19 antibody FMC63 (see Nicholson et al, (1997), Mol. Immunol. 34: 1157-1165), a CD8 alpha hinge and transmembrane domain, and an intracellular domain comprising a 4-1BB and CD3zeta intracellular signaling domains. P-CAR2 comprises a ScFv from anti-CD19 antibody SJ25C1 (see US2013063097), a CD28 hinge and transmembrane domain, and an intracellular domain comprising a CD28 and CD3zeta intracellular signaling domains.

The specific sequences of P-CAR1 and P-CAR2 are listed in Table 9.

TABLE 9

| | |
|---|---|
| P-CAR1 (SEQ ID No 2019) | MALPVTALLLPLALLLHAARPDIQMTQTTSSLSASLGDRVTISCRASQDISKYLN WYQQKPDGTVKLLIYHTSRLHSGVPSRFSGSGSGTDYSLTISNLEQEDIATYFC QQGNTLPYTFGGGTKLEITGGGGSGGGGSGGGGSEVKLQESGPGLVAPSQS LSVTCTVSGVSLPDYGVSWIRQPPRKGLEWLGVIWGSETTYYNSALKSRLTIIK DNSKSQVFLKMNSLQTDDTAIYYCAKHYYYGGSYAMDYWGQGTSVTVSSTTT PAPRPPTPAPTIASQPLSLRPEACRPAAGGAVHTRGLDFACDIYIWAPLAGTC GVLLLSLVITLYCKRGRKKLLYIFKQPFMRPVQTTQEEDGCSCRFPEEEEGGC |

TABLE 9-continued

| | |
|---|---|
| | ELRVKFSRSADAPAYKQGQNQLYNELNLGRREEYDVLDKRRGRDPEMGGKP<br>RRKNPQEGLYNELQKDKMAEAYSEIGMKGERRRGKGHDGLYQGLSTATKDT<br>YDALHMQALPPR |
| P-CAR2<br>(SEQ ID<br>No 2020) | MALPVTALLLPLALLLHAEVKLQQSGAELVRPGSSVKISCKASGYAFSSYWMN<br>VVVKQRPGQGLEWIGQIYPGDGDTNYNGKFKGQATLTADKSSSTAYMQLSGL<br>TSEDSAVYFCARKTISSVVDFYFDYWGQGTTVTVSSGGGGSGGGGSGGGGS<br>DIELTQSPKFMSTSVGDRVSVTCKASQNVGTNVAWYQQKPGQSPKPLIYSAT<br>YRNSGVPDRFTGSGSGTDFTLTITNVQSKDLADYFCQQYNRYPYTSGGGTKL<br>EIKRAAAIEVMYPPPYLDNEKSNGTIIHVKGKHLCPSPLFPGPSKPFWVLVVVG<br>GVLACYSLLVTVAFIIFWVRSKRSRLLHSDYMNMTPRRPGPTRKHYQPYAPPR<br>DFAAYRSRVKFSRSADAPAYQQGQNQLYNELNLGRREEYDVLDKRRGRDPE<br>MGGKPRRKNPQEGLYNELQKDKMAEAYSEIGMKGERRRGKGHDGLYQGLST<br>ATKDTYDALHMQALPPR |

The tested N-CARs comprise an amino acid sequence of SEQ ID No 1999 (ScFv from the anti-PSMA antibody J591 (see WO2004/098535), PD1 hinge and transmembrane domain) and an intracellular domain selected from the sequences listed in Table 10. A CAR comprising only SEQ ID No 1999 (no inhibitory intracellular domain) was used as control (ΔPD1).

TABLE 10

| N-CAR NAME | Intracelullar domain |
|---|---|
| PD1 | CSRAARGTIGARRTGQPLKEDPSAVPVFSVDYGELDFQWREKTPEPPVPC<br>VPEQTEYATIVFPSGMGTSSPARRGSADGPRSAQPLRPEDGHCSWPL<br>(SEQ ID No 2000) |
| BTLA | RRHQGKQNELSDTAGREINLVDAHLKSEQTEASTRQNSQVLLSETGIYDND<br>PDLCFRMQEGSEVYSNPCLEENKPGIVYASLNHSVIGPNSRLARNVKEAPT<br>EYASICVRS (SEQ ID No 2001) |
| CD244 | WRRKRKEKQSETSPKEFLTIYEDVKDLKTRRNHEQEQTFPGGGSTIYSMIQ<br>SQSSAPTSQEPAYTLYSLIQPSRKSGSRKRNHSPSFNSTIYEVIGKSQPKAQ<br>NPARLSRKELENFDVYS (SEQ ID No 2002) |
| PD1-CTLA4 | CSRAARGTIGARRTGQPLKEDPSAVPVFSVDYGELDFQWREKTPEPPVPC<br>VPEQTEYATIVFPSGMGTSSPARRGSADGPRSAQPLRPEDGHCSWPLAVS<br>LSKMLKKRSPLTTGVYVKMPPTEPECEKQFQPYFIPIN (SEQ ID No 2003) |
| PD1-LAG3 | CSRAARGTIGARRTGQPLKEDPSAVPVFSVDYGELDFQWREKTPEPPVPC<br>VPEQTEYATIVFPSGMGTSSPARRGSADGPRSAQPLRPEDGHCSWPLHL<br>WRRQWRPRRFSALEQGIHPPQAQSKIEELEQEPEPEPEPEPEPEPEPEPE<br>QL (SEQ ID No 2004) |
| PD1-PD1 | CSRAARGTIGARRTGQPLKEDPSAVPVFSVDYGELDFQWREKTPEPPVPC<br>VPEQTEYATIVFPSGMGTSSPARRGSADGPRSAQPLRPEDGHCSWPLCS<br>RAARGTIGARRTGQPLKEDPSAVPVFSVDYGELDFQWREKTPEPPVPCVP<br>EQTEYATIVFPSGMGTSSPARRGSADGPRSAQPLRPEDGHCSWPL (SEQ<br>ID No 2005) |
| PD1-TIM3 | CSRAARGTIGARRTGQPLKEDPSAVPVFSVDYGELDFQWREKTPEPPVPC<br>VPEQTEYATIVFPSGMGTSSPARRGSADGPRSAQPLRPEDGHCSWPLFK<br>WYSHSKEKIQNLSLISLANLPPSGLANAVAEGIRSEENIYTIEENVYEVEEPN<br>EYYCYVSSRQQPSQPLGCRFAMP (SEQ ID No 2006) |
| CD300LF | WRMMKYQQKAAGMSPEQVLQPLEGDLCYADLTLQLAGTSPQKATTKLSS<br>AQVDQVEVEYVTMASLPKEDISYASLTLGAEDQEPTYCNMGHLSSHLPGR<br>GPEEPTEYSTISRP (SEQ ID No 2007) |
| LY9 | KRKGRCSVPAFCSSQAEAPADTPEPTAGHTLYSVLSQGYEKLDTPLRPAR<br>QQPTPTSDSSSDSNLTTEEDEDRPEVHKPISGRYEVFDQVTQEGAGHDPA<br>PEGQADYDPVTPYVTEVESVVGENTMYAQVFNLQGKTPVSQKEESSATIY<br>CSIRKPQVVPPPQQNDLEIPESPTYENFT (SEQ ID No 2008) |
| PECAM | KCYFLRKAKAKQMPVEMSRPAVPLLNSNNEKMSDPNMEANSHYGHNDDV<br>RNHAMKPINDNKEPLNSDVQYTEVQVSSAESHKDLGKKDTETVYSEVRKA<br>VPDAVESRYSRTEGSLDGT (SEQ ID No 2009) |
| SIGLEC9 | VRSCRKKSARPAAGVGDTGIEDANAVRGSASQGPLTEPWAEDSPPDQPP<br>PASARSSVGEGELQYASLSFQMVKPWDSRGQEATDTEYSEIKIHR (SEQ<br>ID No 2010) |
| SIRPA | RIRQKKAQGSTSSTRLHEPEKNAREITQDTNDITYADLNLPKGKKPAPQAAE<br>PNNHTEYASIQTSPQPASEDTLTYADLDMVHLNRTPKQPAPKPEPSFSEYA<br>SVQVPRK (SEQ ID No 2011) |

TABLE 10-continued

| N-CAR NAME | Intracelullar domain |
|---|---|
| PD1-L2-ITSM | CSRAARGTIGARRTGQPLKEDPSAVPVFSVDYGELDFQWREKTPEPPVPC VPEQTEYATIDFQWREKTPEPPVPCVPEQTEYATIVFPSGMGTSSPARRGS ADGPRSAQPLRPEDGHCSWPL (SEQ ID No 2012) |
| PD1-L2-ITSM-L2-ITSM | CSRAARGTIGARRTGQPLKEDPSAVPVFSVDYGELDFQWREKTPEPPVPC VPEQTEYATIDFQWREKTPEPPVPCVPEQTEYATIDFQWREKTPEPPVPCV PEQTEYATIVFPSGMGTSSPARRGSADGPRSAQPLRPEDGHCSWPL (SEQ ID No 2013) |
| PD1 (ITSM mut 1) | CSRAARGTIGARRTGQPLKEDPSAVPVFSVDYGELDFQWREKTPEPPVPC VPEQTEYSEIVFPSGMGTSSPARRGSADGPRSAQPLRPEDGHCSWPL (SEQ ID No 2014) |
| PD1 (ITSM mut 2) | CSRAARGTIGARRTGQPLKEDPSAVPVFSVDYGELDFQWREKTPEPPVPC VPEQTEYSEVVFPSGMGTSSPARRGSADGPRSAQPLRPEDGHCSWPL (SEQ ID No 2015) |
| PD1 (ITSM mut3) | CSRAARGTIGARRTGQPLKEDPSAVPVFSVDYGELDFQWREKTPEPPVPC VPEQTEYASIVFPSGMGTSSPARRGSADGPRSAQPLRPEDGHCSWPL (SEQ ID No 2016) |
| PD1-KIR2DL2 | CSRAARGTIGARRTGQPLKEDPSAVPVFSVDYGELDFQWREKTPEPPVPC VPEQTEYATIVFPSGMGTSSPARRGSADGPRSAQPLRPEDGHCSWPLHR WCSNKKNAAVMDQESAGNRTANSEDSDEQDPQEVTYTQLNHCVFTQRKI TRPSQRPKTPPTDIIVYAELPNAESRSKVVSCP (SEQ ID No 2017) |

Three days after transduction, Jurkat cells were placed into antibiotic selection media to select for pools of stable CAR-expressing clones.

Figure 2:
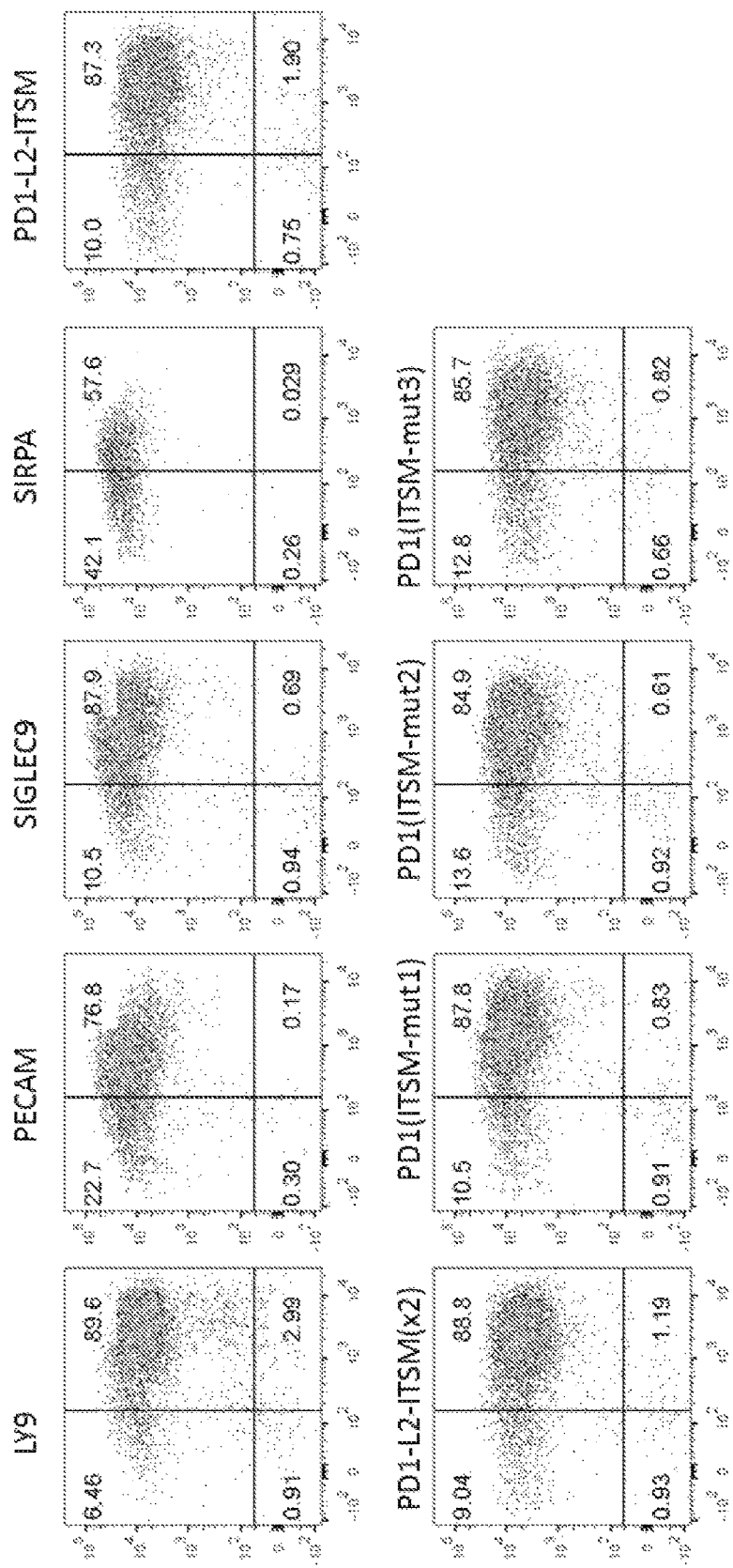
Figure 6:
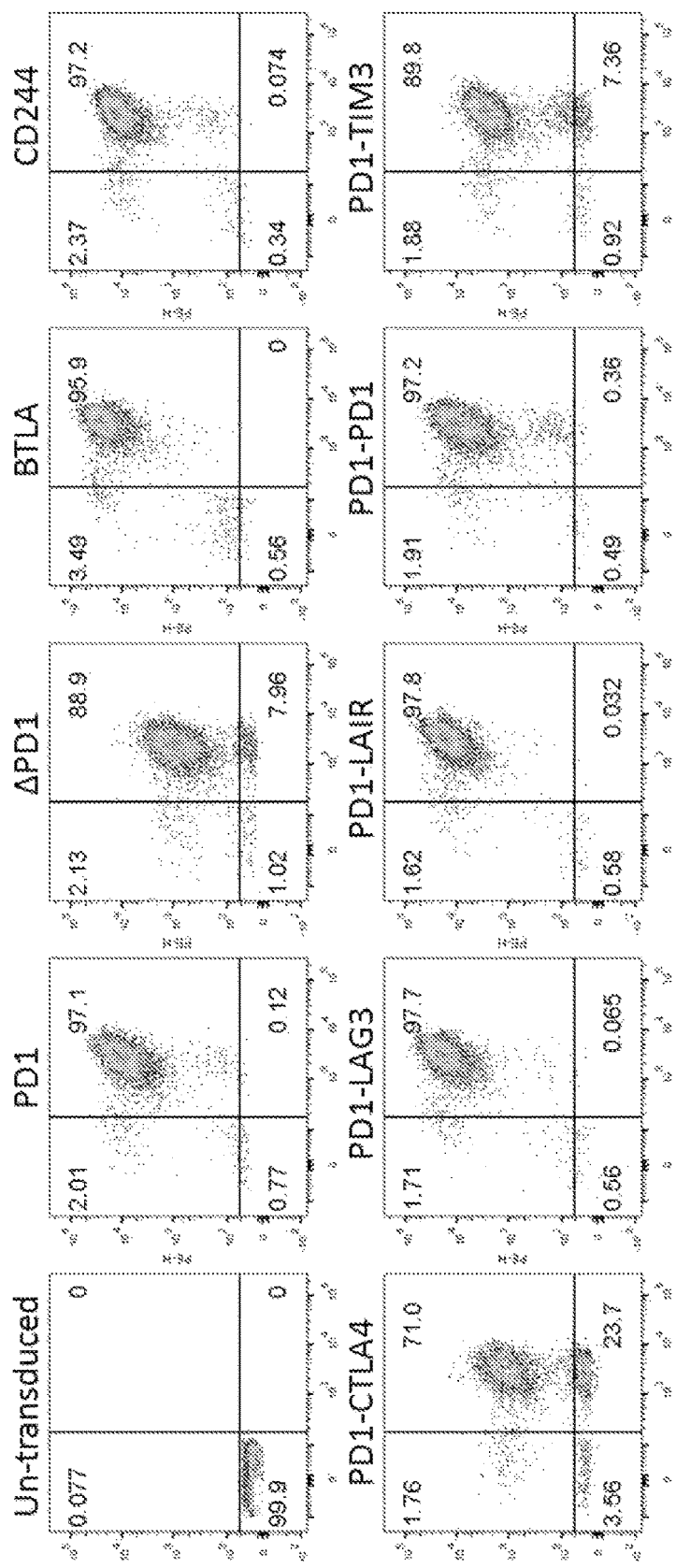
FIGS. 6 and 7 show the dual cell surface expression of P-CAR2 and N-CARs listed in Table 10 assessed by multicolor flow cytometry in transduced NFAT-luciferase reporter Jurkat cells.
Figure 7:
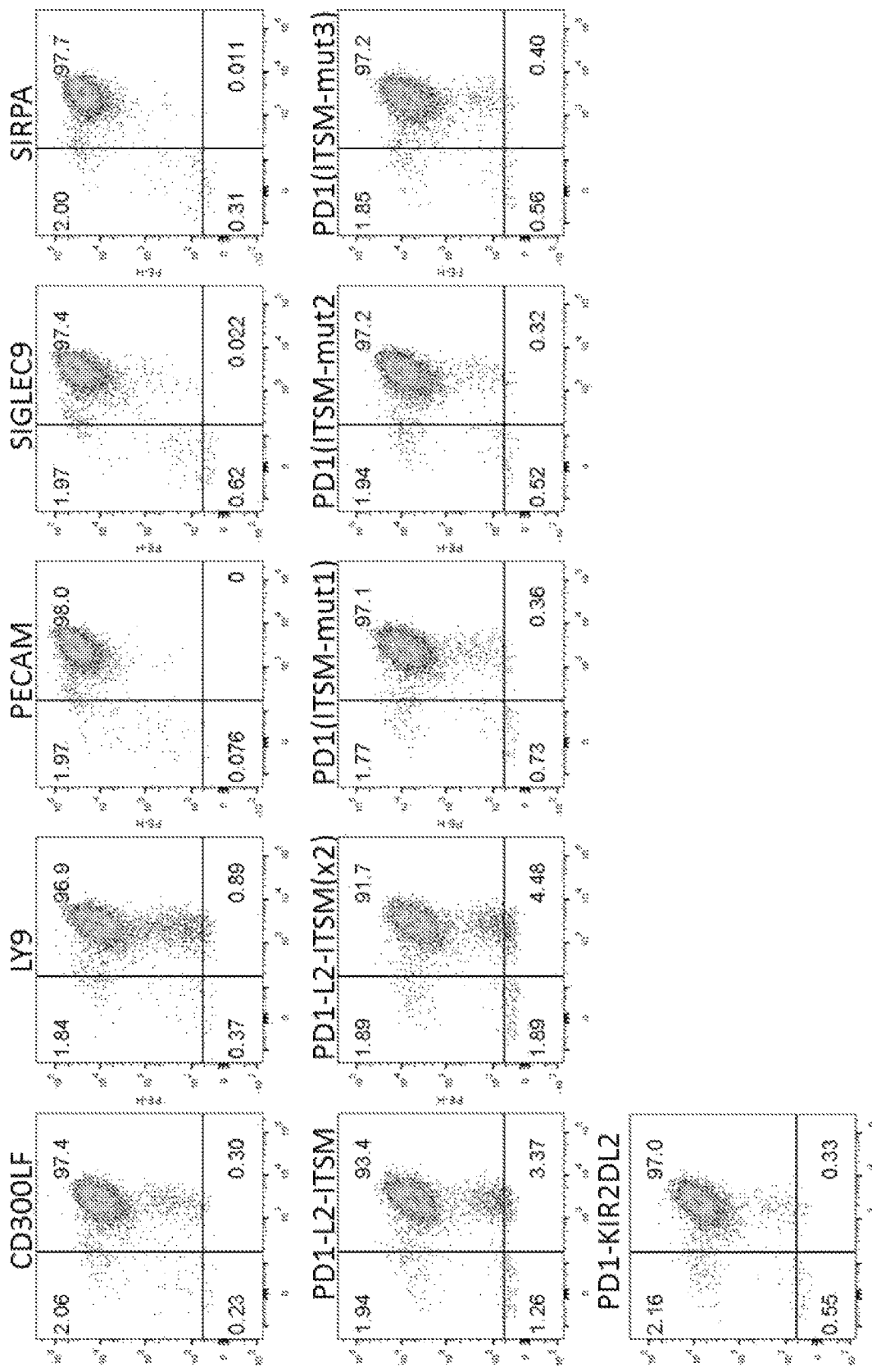
Figure 8:
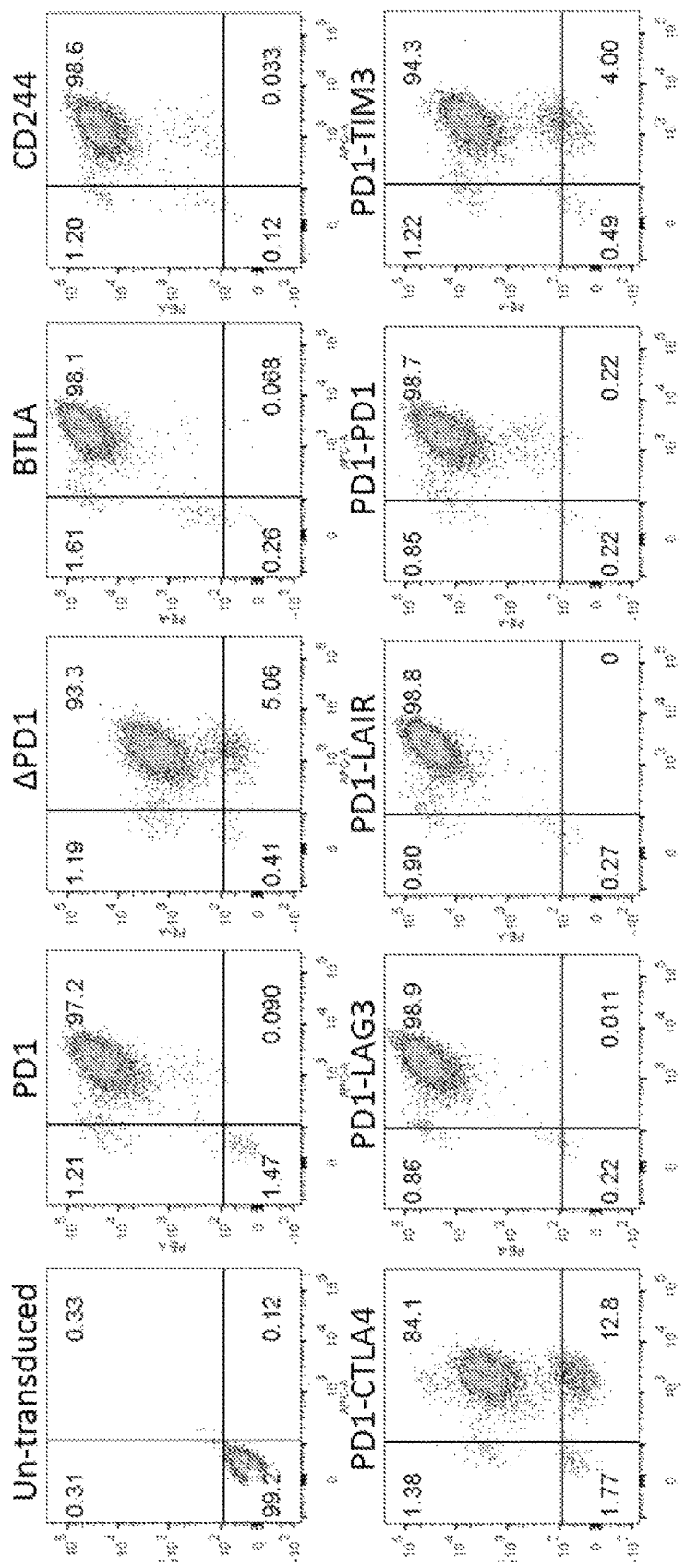
FIGS. 8 and 9 show the dual cell surface expression of P-CAR2 and N-CARs listed in Table 10 assessed by multicolor flow cytometry in transduced NFkB-luciferase reporter Jurkat cells.
Figure 9:
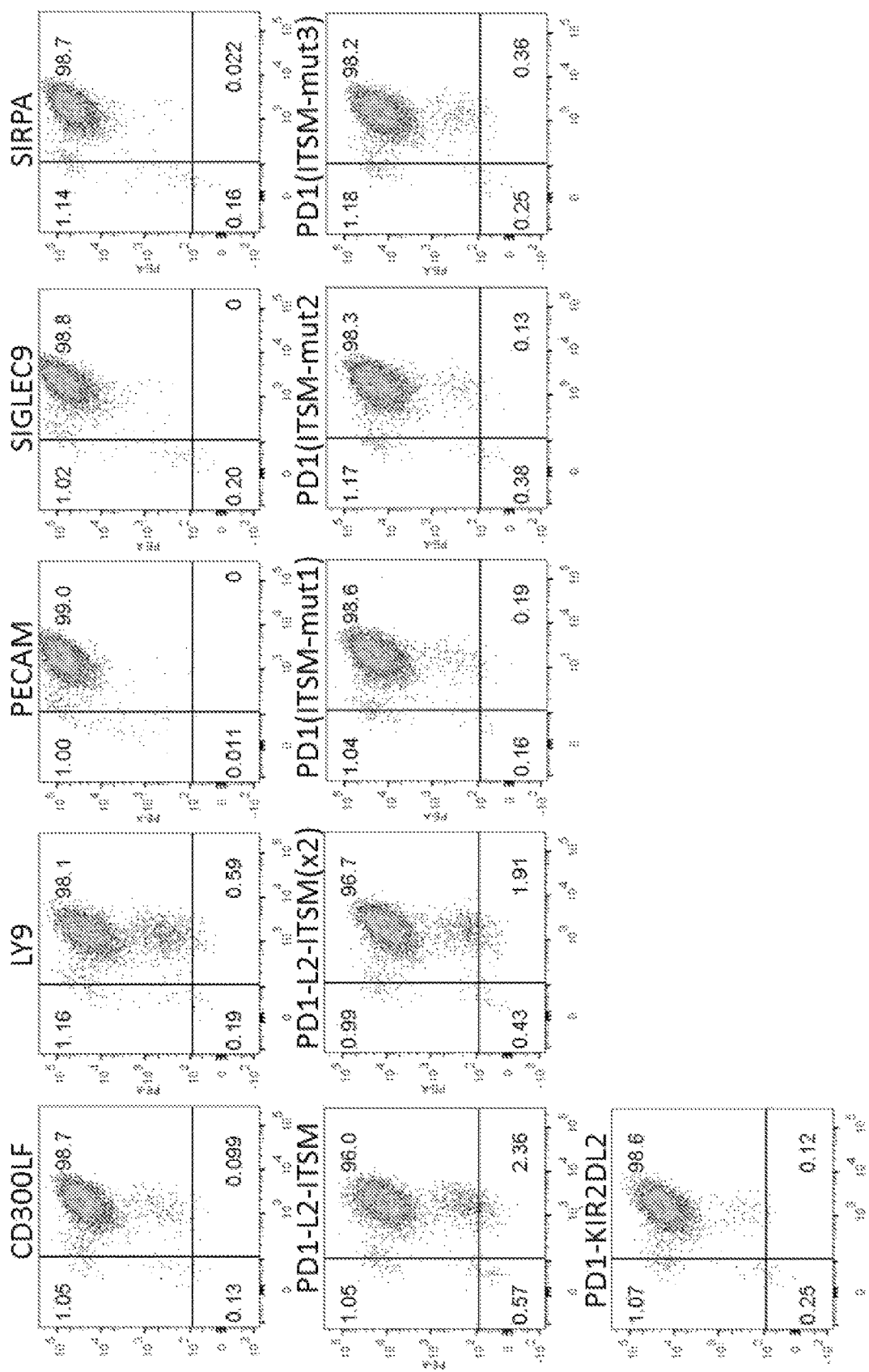

Dual cell surface expression of P-CAR1 (Table 9) and N-CARs listed in Table 10 assessed by multicolor flow cytometry in transduced NFAT-luciferase reporter Jurkat cells is shown in FIGS. 1 and 2. Dual cell surface expression of P-CAR1 (Table 9) and N-CARs listed in Table 10 assessed by multicolor flow cytometry in transduced NFkB-luciferase reporter Jurkat cells is shown in FIGS. 3 and 4. Dual cell surface expression of P-CAR2 (Table 9) and N-CARs listed in Table 10 assessed by multicolor flow cytometry in transduced NFAT-luciferase reporter Jurkat cells is shown in FIGS. 6 and 7. Dual cell surface expression of P-CAR2 and N-CARs listed in Table 10 assessed by multicolor flow cytometry in transduced NFkB-luciferase reporter Jurkat cells is shown in FIGS. 8 and 9.

Cells were sequentially transduced with P-CAR and N-CAR lentivirus, and selected for antibiotic-resistant clones after each transduction. Intracellular domains of the various N-CARs are shown above each dot plot. P-CAR expression was detected using a recombinant human CD19-mouse IgG Fc fusion protein followed by APC-conjugated F(ab')2 goat anti-mouse Fcγ (shown on x axis), and N-CAR expression was detected with a biotinylated recombinant human PSMA-human IgG1 Fc fusion protein followed by PE-conjugated streptavidin (y axis).

In Vitro T Cell Activation Assay

For coculture assays, effector Jurkat cells expressing different combinations of P- and N-CARs were cocultured with AAPCs expressing either CD19 (on-target), both CD19 and PSMA (off-target), or neither antigen (empty vector transduced). AAPC target cells were plated at a density of 20,000 cells per well in tissue culture-treated flat-bottom white 96-well plates (Corning COSTAR). Plates were incubated at 37° C. in 5% $CO_2$ for 24 hours, after which time media was removed and 100,000 Control ΔPD1- or test N-CAR-transduced luciferase reporter Jurkat cells expressing P-CAR1 or P-CAR2 were added to each well in a volume of 100 uL. After a 16-hour incubation at 37° C., 100 uL Bright-Glo luciferase substrate (Promega) was added per well, plates were shaken for 2 minutes, and relative luciferase units (RLU) quantified on a Perkin Elmer EnVision Multilabel Reader. Each Jurkat cell line was tested in sextuplicate and results presented as a ratio of the mean RLU value from coculture with off-target AAPCs to the mean RLU from coculture with target AAPCs.

Figure 5A:
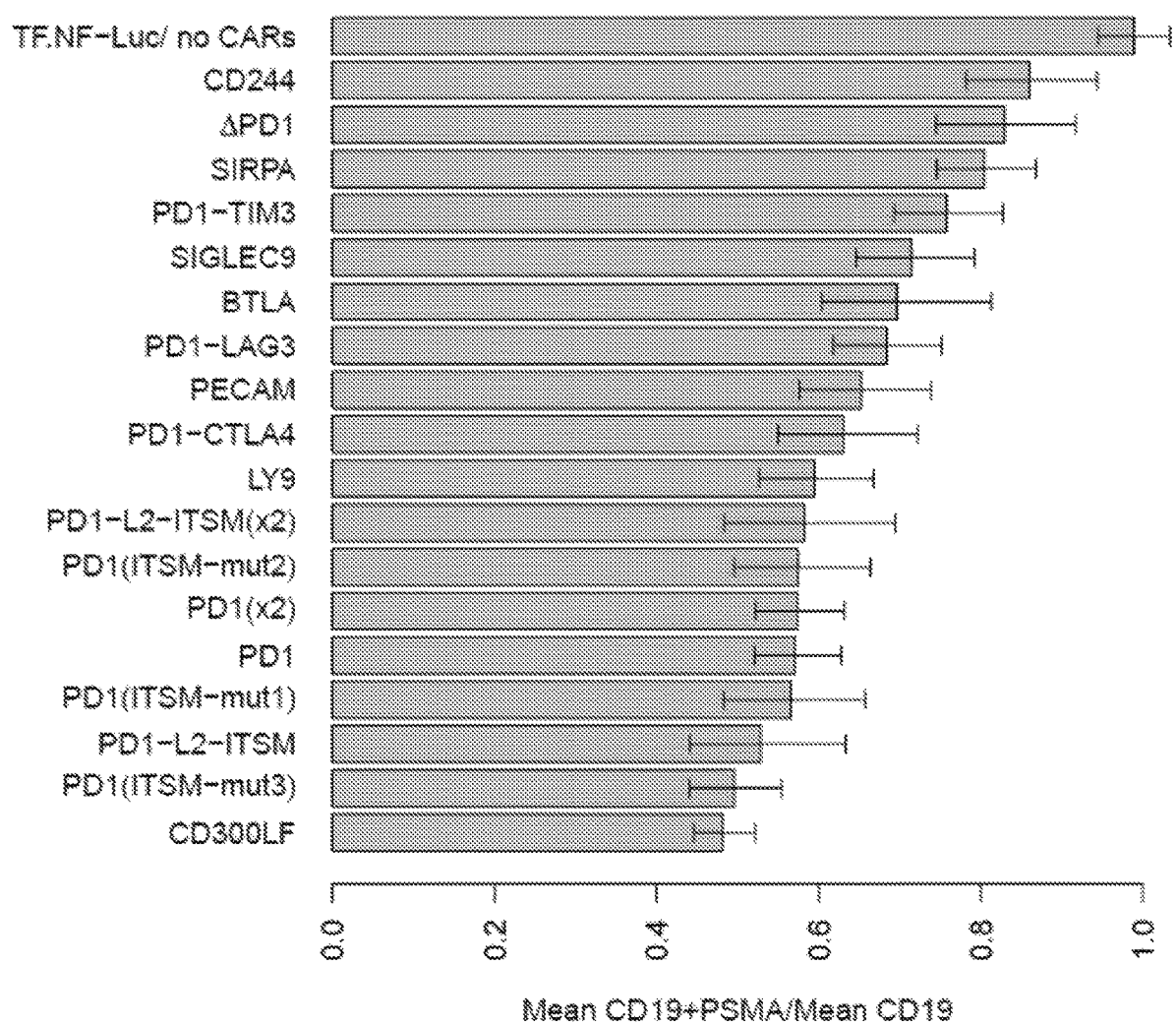
FIGS. 5A, 5B and 5C show the inhibitory effect of various N-CARs on P-CAR1 induced T cell activation. Control ΔPD1- or test N-CAR-transduced luciferase reporter Jurkat cells expressing P-CAR1 were incubated with either CD19-expressing AAPCs or dual CD19+PSMA-expressing AAPCs, and luciferase activity was assessed 16 h later. Data are expressed as a ratio of the mean RLU from co-culture with CD19+PSMA AAPCs/CD19 AAPCs. n=6 replicates per sample; data shown are the means+/−95% CI).
Figure 5B:
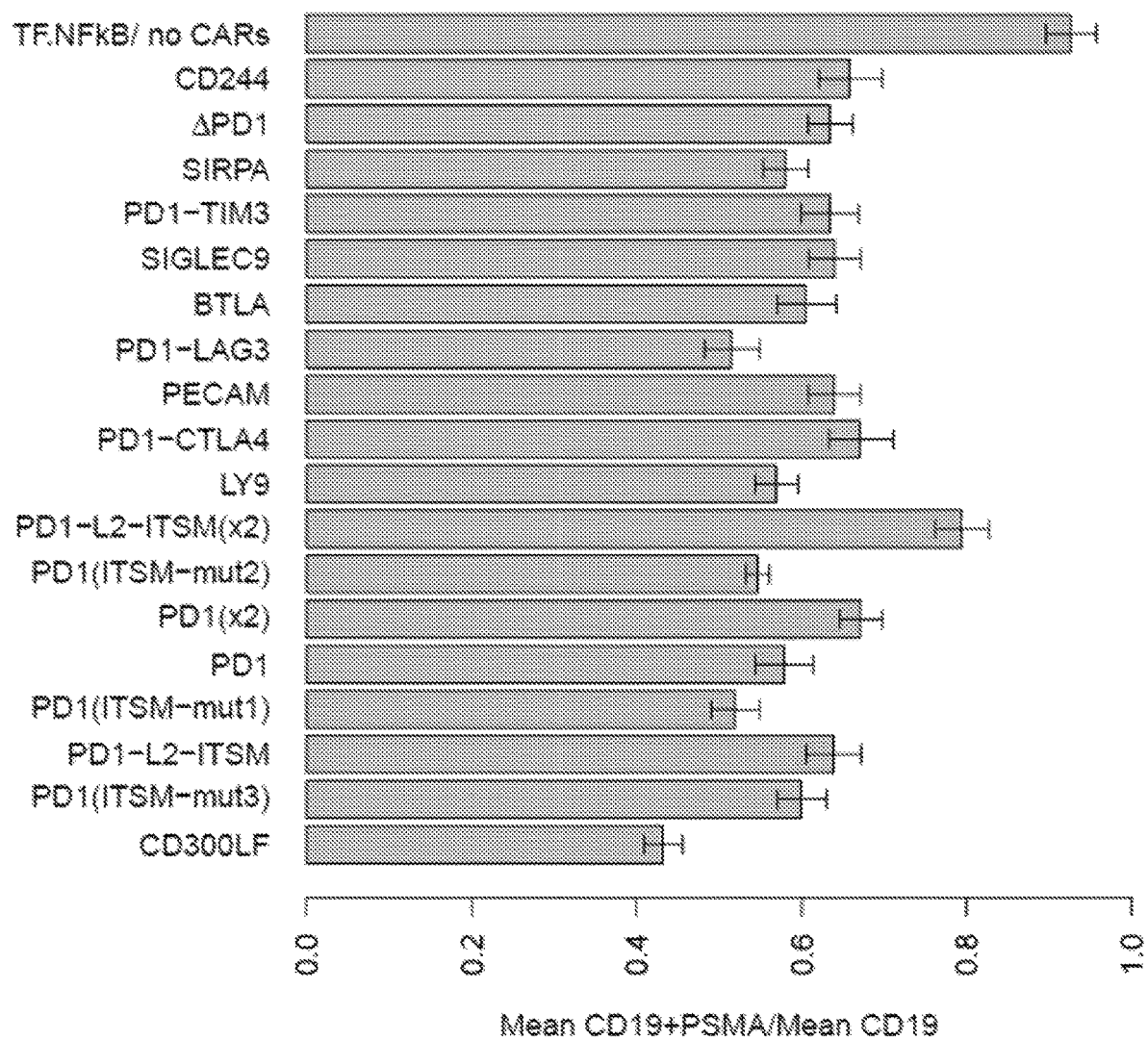
Figure 5C:
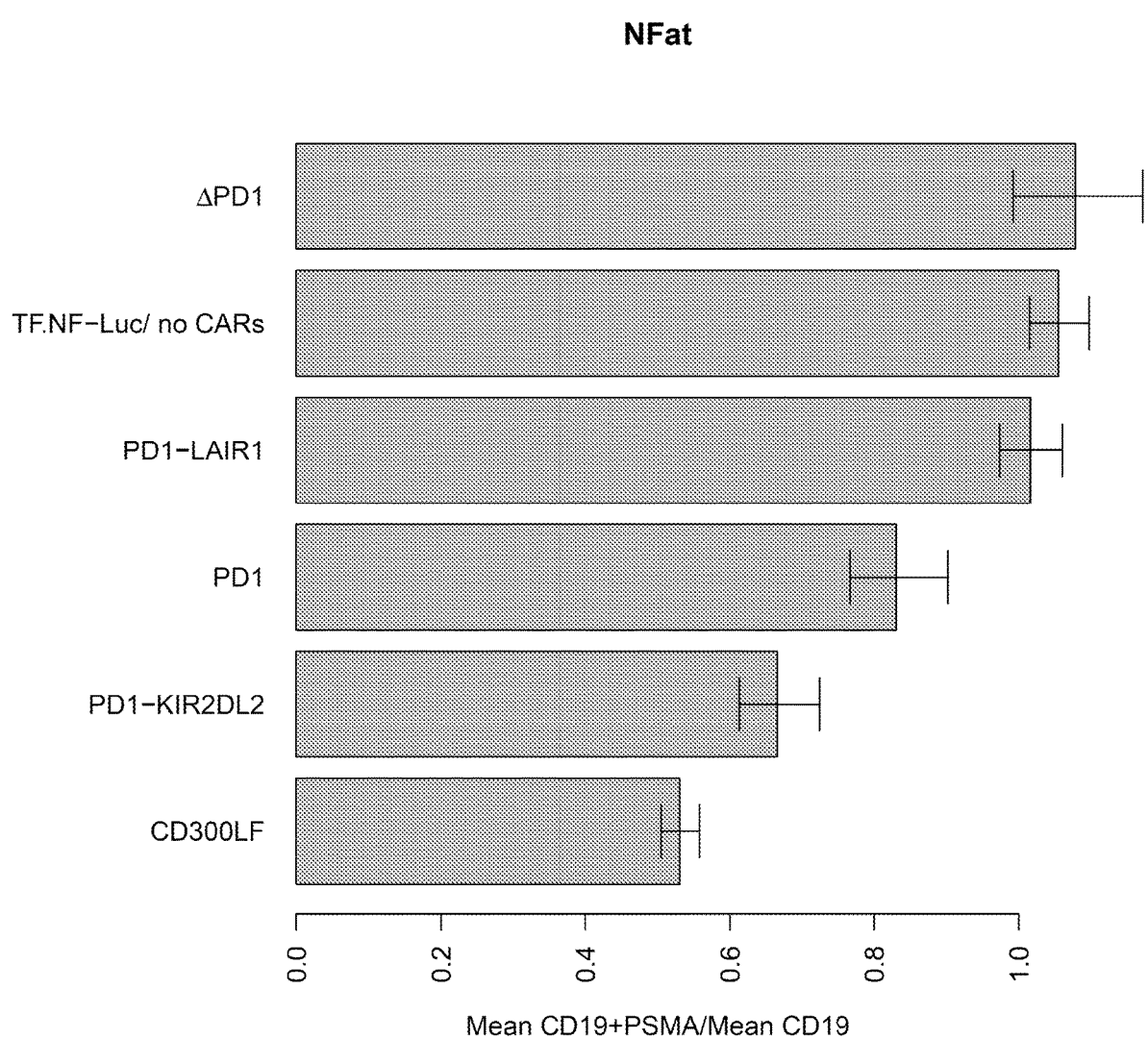

FIGS. 5A, 5B and 5C show the inhibitory effect of various N-CARs on P-CAR1 induced T cell activation. Control ΔPD1- or test N-CAR-transduced luciferase reporter Jurkat cells expressing P-CAR1 were incubated with either CD19-expressing AAPCs or dual CD19+PSMA-expressing AAPCs, and luciferase activity was assessed 16 h later. Data are expressed as a ratio of the mean RLU from co-culture with CD19+PSMA AAPCs/CD19 AAPCs. n=6 replicates per sample; data shown are the means±SEM. FIGS. 5A/5C and 5B show results using NFAT-luciferase reporter and NFkB-luciferase reporter Jurkat cells, respectively.

Figure 10A:
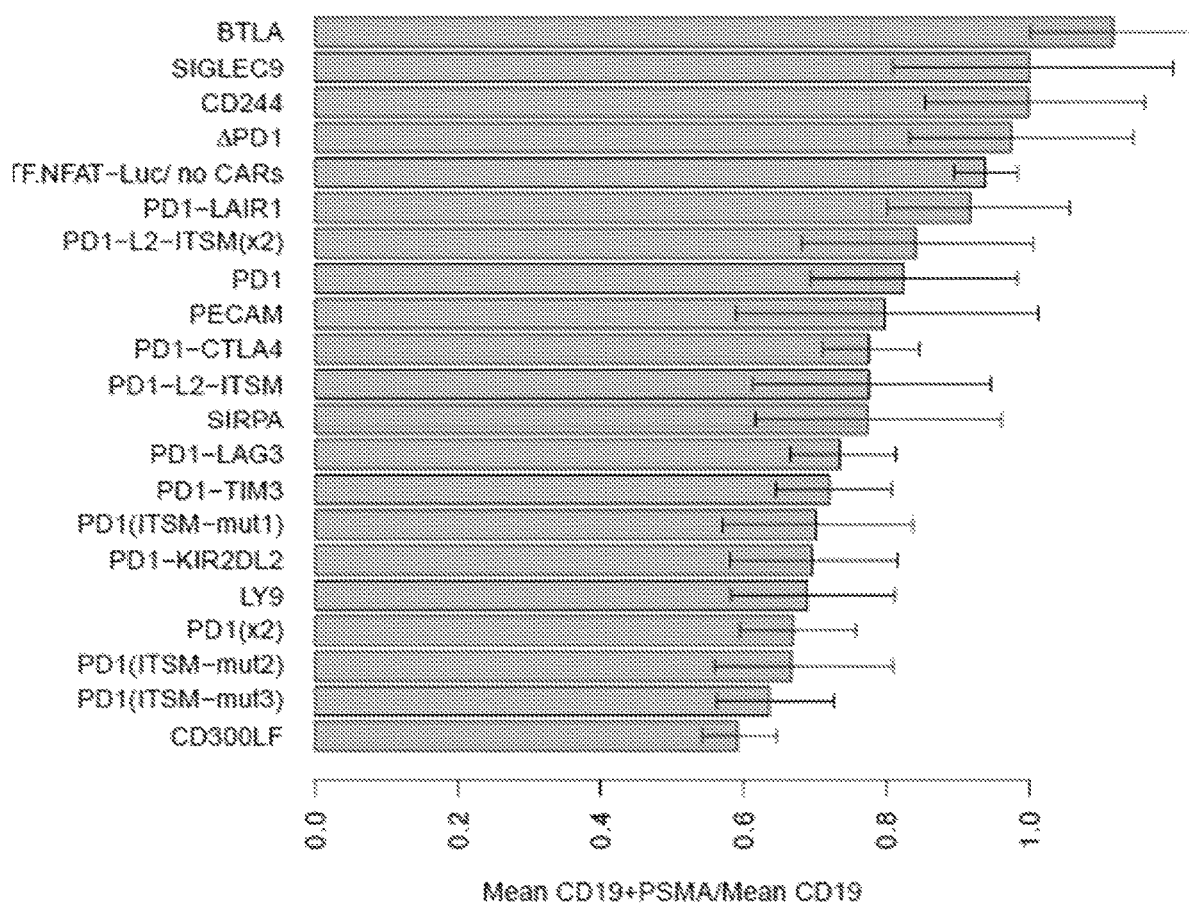
FIGS. 10A and 10B show the inhibitory effect of various N-CARs on P-CAR2 induced T cell activation. Control ΔPD1- or test N-CAR-transduced luciferase reporter Jurkat cells expressing P-CAR2 were incubated with either CD19-expressing or dual PSMA/CD19-expressing AAPCs, and luciferase activity was assessed 16 h later. Data are expressed as a ratio of the mean RLU from co-culture with CD19+PSMA AAPCs/CD19 AAPCs. n=6 replicates per sample; data shown are the means+/−95% Cl.
Figure 10B:
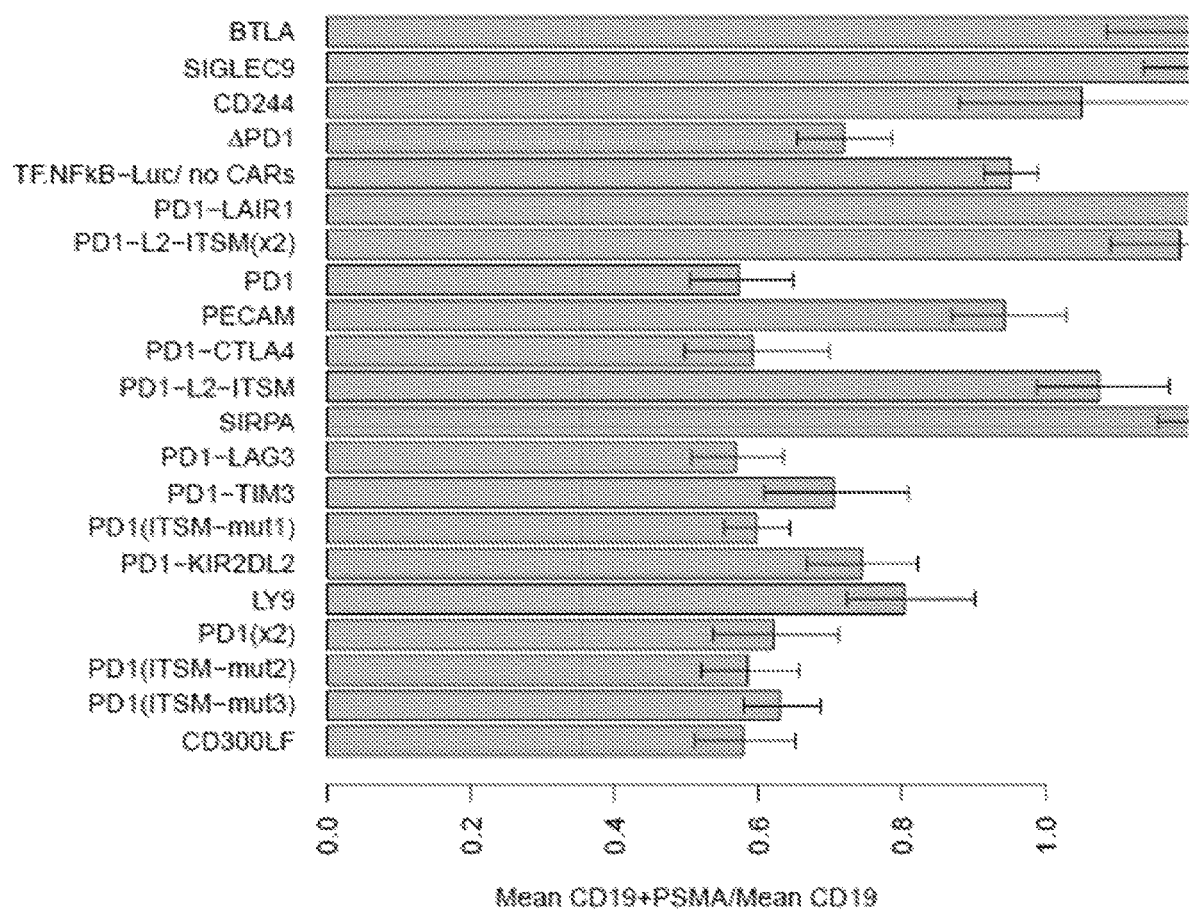

FIGS. 10A and 10B show the inhibitory effect of various N-CARs on P-CAR2 induced T cell activation. Control ΔPD1- or test N-CAR-transduced luciferase reporter Jurkat cells expressing P-CAR2 were incubated with either CD19-expressing or dual PSMA/CD19-expressing AAPCs, and luciferase activity was assessed 16 h later. Data are expressed as a ratio of the mean RLU from co-culture with CD19+PSMA AAPCs/CD19 AAPCs. n=6 replicates per sample; data shown are the means±SEM. FIGS. 10A and 10B show results using NFAT-luciferase reporter and NFkB-luciferase reporter Jurkat cells, respectively.

Example 4—Activity of P-CAR$^+$/N-CAR$^+$ T-Cells in Primary Human T-Cells

The N-CAR designed according to example 2 are also optionally tested in primary human T-cells to ensure that the results from example 3 obtained with Jurkat T-cells translate to primary cells. This can be done by first transducing N-CAR constructs into primary human T-cells obtained according to methods known to the skilled person and monitoring the attenuation of T-cell activation by anti-CD3/

CD28 stimulation in the absence and presence of N-CAR antigen. In addition, the P-CAR and N-CAR constructs disclosed in example 3 can also be transduced into primary human T-cells and tested on CD19, PSMA, and CD19/PSMA cells.

Example 5—Activity of T-Cells Comprising P-CAR and N-CAR in Xenograft Studies

P-CAR and N-CAR constructs as disclosed in Example 3 can be transduced into primary human T-cells and tested for efficacy in xenograft studies in NSG animals transplanted with tumors expressing, either only CD19 or both CD19 and PSMA. NSG mice are transplanted with luciferase labeled $10^5$-$10^6$ cells expressing either CD19 or CD19 and PSMA. A few days after engraftment, these animals are infused with $10^4$-$10^6$ P-CAR$^+$/N-CAR$^+$ T-cells intravenously. The animals are dosed with luciferin prior to imaging on the IVIS imaging system routinely to monitor tumor load.

The invention is further illustrated by the following embodiments:

1. An inhibitory chimeric antigen receptor (N-CAR) comprising an extracellular domain comprising an antigen binding domain, a transmembrane domain, an intracellular domain, and, wherein the intracellular domain comprises an immunoreceptor Tyrosine-based Switch Motif ITSM, wherein said ITSM is a sequence of amino acid $TX_1YX_2X_3X_4$ (SEQ ID NO: 2049), wherein $X_1$ is an amino acid $X_2$ is an amino acid $X_3$ is an amino acid and $X_4$ is V or I.

2. The N-CAR according to embodiment 1, wherein when the extracellular domain is a scFv against PSMA, then the intracellular domain is not the intracellular domain of human PD-1.

3. The N-CAR according to embodiment 1 or 2, wherein the extracellular domain does not bind to PMSA.

4. The N-CAR according to any one of embodiments 1 to 3, wherein the intracellular domain does not comprise the full intracellular domain of PD-1.

5. The N-CAR according to any one of embodiments 1 to 4, wherein ITSM motif is not TEYATI (SEQ ID NO: 937).

5.1 The N-CAR according to any one of embodiments 1 to 5, wherein the intracellular domain is not the intracellular domain of human PD1.

5.2 The N-CAR according to any one of embodiments 1 to 5, wherein the intracellular domain is not the intracellular domain of human BTLA.

5.3 The N-CAR according to any one of embodiments 1 to 5, wherein the intracellular domain is not the intracellular domain of human CD244.

5.4 The N-CAR according to any one of embodiments 1 to 5, wherein the intracellular domain is not SEQ ID No 2000, SEQ ID No 2001 or SEQ ID No 2002.

6. The N-CAR according to any one of embodiments 1 to 5.4, wherein the intracellular domain comprises the sequence $((L1\text{-}ITIM\text{-}L2)^n\text{-}(L3\text{-}ITSM\text{-}L4)^m)^p$, wherein n is 0, 1 or an integer greater than 1;

m is 1 or an integer greater than 1;

p is 1 or an integer greater than 1;

L1 is absent or comprises one or more, preferably one, sequences selected from the group consisting of:
 (a) a naturally occurring N-terminal flanking region of an ITIM only intracellular domains or a fragment thereof;
 (b) a naturally occurring N-terminal flanking region of an ITIM.*ITSM intracellular domains or a fragment thereof;
 (c) a naturally occurring intracellular domain from a known inhibitory receptor, wherein the said intracellular domain is N-terminally flanking to a sequence in (c) above, or a fragment thereof; and,
 (d) a non-naturally occurring sequence comprising between 1 and 500 amino acids;

each of L2 and L3 is absent or comprises one or more, preferably one, sequences selected from the group consisting of:
 (e) a naturally occurring C-terminal flanking region of an ITIM only intracellular domain or a fragment thereof;
 (f) a naturally occurring N-terminal flanking region of an ITSM only intracellular domain or a fragment thereof;
 (g) a naturally occurring intracellular domain between ITIM and ITSM from proteins that have ITIM.*ITSM motif or a fragment thereof;
 (h) a naturally occurring intracellular domain from a known inhibitory receptor wherein the said intracellular domain is N-terminally flanking to a sequence in (f) or (g) above, or a fragment thereof; and
 (i) a non-naturally occurring sequence comprising between 1 and 500 amino acids; and L4 is absent or comprises one or more, preferably one, sequences selected from the group consisting of:
 (j) a naturally occurring C-terminal flanking region of an ITIM.*ITSM intracellular domain or a fragment thereof;
 (k) a naturally occurring C-terminal flanking region of an ITSM only intracellular domain or a fragment thereof;
 (l) a naturally occurring intracellular domain from a known inhibitory receptor wherein the said intracellular domain is C-terminally flanking to a sequence in (j) or (k) above; or a fragment thereof and
 (m) a non-naturally occurring sequence comprising between 1 and 500 amino acids, the ITIM is the sequence $X_5X_6YX_7X_8X_9$ (SEQ ID NO: 2050), wherein $X_5$ is S, V, I or L, $X_6$ is an amino acid, $X_7$ is an amino acid, $X_8$ is an amino acid, and, $X_9$ is V, I or L, and the ITSM is the sequence $TX_1YX_2X_3X_4$ (SEQ ID NO: 2049), wherein $X_1$ is an amino acid, $X_2$ is an amino acid, $X_3$ is an amino acid, and, $X_4$ is V or I, or a variant thereof.

7. The N-CAR according to embodiment 6, wherein
L1 is absent or comprises one or more, preferably one, sequences selected from the group consisting of:
   (a) a naturally occurring N-terminal flanking region of ITIM only intracellular domains selected from the sequences shown in Table 3 or a fragment thereof;
   (b) a naturally occurring N-terminal flanking region of ITIM.*ITSM intracellular selected from the sequences shown in Table 1 or a fragment thereof;
   (c) a naturally occurring intracellular domain from a known inhibitory receptor selected from the sequences shown in Table 2 or a fragment thereof, wherein said intracellular domain is N-terminally flanking to a sequence in (b) above, or a fragment thereof; and
   (d) a non-naturally occurring sequence comprising between 1 and 500 amino acids;

each of L2 and L3 is absent or comprises one or more, preferably one, sequences selected from the group consisting of:
   (e) a naturally occurring C-terminal flanking region of ITIM only intracellular domains selected from the sequences shown in Table 4 or a fragment thereof;
   (f) a naturally occurring N-terminal flanking region of ITSM only intracellular domains selected from the sequences shown in Table 6, or a fragment thereof;
   (g) a naturally occurring intracellular domain between ITIM and ITSM from proteins that have ITIM.*ITSM motif selected from the sequences shown in Table 5, or a fragment thereof;
   (h) a naturally occurring intracellular domain from a known inhibitory receptor selected from the sequences shown in Table 2 or a fragment thereof wherein said intracellular domain is N-terminally flanking to a sequence in (f) or (g) above, or a fragment thereof; and
   (i) a non-naturally occurring sequence comprising between 1 and 500 amino acids; and L4 is absent or comprises one or more, preferably one, sequences selected from the group consisting of:
   (j) a naturally occurring C-terminal flanking region of ITIM.*ITSM intracellular domains selected from the sequences shown in Table 7, or a fragment thereof;
   (k) a naturally occurring C-terminal flanking region of ITSM only intracellular domains selected from the sequences shown in Table 8, or a fragment thereof;
   (l) a naturally occurring intracellular domain from a known inhibitory receptor selected from the sequences shown in Table 2 or a fragment thereof wherein said intracellular domain is C-terminally flanking to a sequence in (l) above, or a fragment thereof; and,
   (m) a non-naturally occurring sequence comprising between 1 and 500 amino acids.

8. The N-CAR according to embodiment 6 or 7 wherein the intracellular domain comprises the sequence (L1-ITIM-L2-L3-ITSM-L4)$^p$ wherein
p is 1, 2, 3, 4 or 5;
L1 is a naturally occurring N-terminal flanking region of an ITIM only intracellular domain or a fragment thereof such as, for example, any of the sequences shown in Table 3 or a fragment thereof;
L2 is absent;
L3 is a naturally occurring a naturally occurring intracellular domain between ITIM and ITSM from proteins that have ITIM.*ITSM motif or a fragment thereof such as, for example, any of the sequences shown in Table 5 or a fragment thereof;
L4 is a naturally occurring C-terminal flanking region of an ITIM.*ITSM intracellular domain or a fragment thereof such as, for example, any of the sequences shown in Table 7 or a fragment thereof; or a naturally occurring C-terminal flanking region of an ITSM only intracellular domain such as, for example, any of the sequences shown in Table 8 or a fragment thereof.

9. The N-CAR according to any one of embodiments 6 to 8 wherein L1 is absent or comprises one or more, preferably one, sequences or selected from the group consisting of:
   (a) a naturally occurring N-terminal flanking region of ITIM only intracellular domains selected from

YKMYGSEMLHKRDPLDEDEDTD (SEQ ID NO: 4)

DHWALTQRTARAVSPQSTKPMAES (SEQ ID NO: 194)

CSRAARGTIGARRTGQPLKEDPSAVPVFS (SEQ ID NO: 7)

HRQNQIKQGPPRSKDEEQKPQQRPDLAVDVLERTADKATVNGLPEKDRET

DTSALAAGSSQE (SEQ ID NO: 268)

KTHRRKAARTAVGRNDTHPTTGSASPKHQKKSKLHGPTETSSCSGAAPTV

EMDEE (SEQ ID NO: 12)

LTRKKKALRIHSVEGDLRRKSAGQEEWSPSAPSPPGSCVQAEAAPAGLCG

EQRGEDCAELHDYFNV (SEQ ID NO: 307)

KCYFLRKAKAKQMPVEMSRPAVPLLNSNNEKMSDPNMEANSHYGHNDDVR

NHAMKPINDNKEPLNSD (SEQ ID NO: 18)

RRHQGKQNELSDTAGREINLVDAHLKSEQTEASTRQNSQVLLSETGIYDN

DPDLCFRMQEGSEVYSNPCLEENKPG (SEQ ID NO:20)

WRMMKYQQKAAGMSPEQVLQPLEGDLCYADLTLQLAGTSPQKATTKLSSA

QVDQVEVEYVTMASLPKED (SEQ ID NO: 347)

KRVQETKFGNAFTEEDSELVVNYIAKKSFCRRAIELTLHSLGVSEELQNK

LEDVVIDRNLLILGKILGEGEFGSVMEGNLKQEDGTSLKVAVKTMKLDNS

SQREIEEFLSEAACMKDFSHPNVIRLLGVCIEMSSQGIPKPMVILPFMKY

GDLHTY (SEQ ID NO: 26)

(b) a naturally occurring N-terminal flanking region of ITIM.*ITSM intracellular domains selected from

YKMYGSEMLHKRDPLDEDEDTD (SEQ ID NO: 4)

WRMMKYQQKAAGMSPEQVLQPLEGD (SEQ ID NO: 6)

CSRAARGTIGARRTGQPLKEDPSAVPVFS (SEQ ID NO: 7)

RIRQKKAQGSTSSTRLHEPEKNAREITQDTND (SEQ ID NO: 8)

KTHRRKAARTAVGRNDTHPTTGSASPKHQKKSKLHGPTETSSCSGAAPTV

EMDEE (SEQ ID NO: 12)

KCYFLRKAKAKQMPVEMSRPAVPLLNSNNEKMSDPNMEANSHYGHNDDVR

NHAMKPINDNKEPLNSD (SEQ ID NO: 18)

RRHQGKQNELSDTAGREINLVDAHLKSEQTEASTRQNSQVLLSETGIYDN

DPDLCFRMQEGSEVYSNPCLEENKPG (SEQ ID NO: 20)

KRVQETKFGNAFTEEDSELVVNYIAKKSFCRRAIELTLHSLGVSEELQNK

LEDVVIDRNLLILGKILGEGEFGSVMEGNLKQEDGTSLKVAVKTMKLDNS

SQREIEEFLSEAACMKDFSHPNVIRLLGVCIEMSSQGIPKPMVILPFMKY

GDLHTY (SEQ ID NO: 26)

(c) a naturally occurring intracellular domain from a known inhibitory receptor selected from the sequences shown in table 2, wherein said intracellular domain is N-terminally flanking to a sequence in (b) above; and (d) a non-naturally occurring sequence comprising between 1 and 500 amino acids.

10. A N-CAR according to any one of embodiments 6 to 9 wherein each of L2 and L3 is absent or comprises one or more, preferably one, sequences selected from the group consisting of:

(e) a naturally occurring C-terminal flanking region of ITIM only intracellular domains selected from;

GNCSFFTETG (SEQ ID NO: 423)

NFHGMNPSKDTSTEYSEVRTQ (SEQ ID NO: 485)

KEEEMADTSYGTVKAENIIMMETAQTSL (SEQ ID NO: 521)

NHSVIGPNSRLARNVKEAPTEYASICVRS (SEQ ID NO: 525)

DHWALTQRTARAVSPQSTKPMAESITYAAVARH (SEQ ID NO: 529)

QVSSAESHKDLGKKDTETVYSEVRKAVPDAVESRYSRTEGSLDGT
(SEQ ID NO: 576)

DFQWREKTPEPPVPCVPEQTEYATIVFPSGMGTSSPARRGSADGPRSAQP

LRPEDGHCSWPL (SEQ ID NO: 611)

NLPKGKKPAPQAAEPNNHTEYASIQTSPQPASEDTLTYADLDMVHLNRTP

KQPAPKPEPSFSEYASVQVPRK (SEQ ID NO: 683)

TLQLAGTSPQKATTKLSSAQVDQVEVEYVTMASLPKEDISYASLTLGAED

QEPTYCNMGHLSSHLPGRGPEEPTEYSTISRP (SEQ ID NO: 684)

ETGPKHIPLQTLLKFMVDIALGMEYLSNRNFLHRDLAARNCMLRDDMTVC

VADFGLSKKIYSGDYYRQGRIAKMPVKWIAIESLADRVYTSKSDVWAFGV

TMWEIATRGMTPYPGVQNHEMYDYLLHGHRLKQPEDCLDELYEIMYSCWR

TDPLDRPTFSVLRLQLEKLLESLPDVRNQADVIYVNTQLLESSEGLAQGS

TLAPLDLNIDPDSIIASCTPRAAISVVTAEVHDSKPHEGRYILNGGSEEW

EDLTSAPSAAVTAEKNSVLPGERLVRNGVSWSHSSMLPLGSSLPDELLFA

DDSSEGSEVLM (SEQ ID NO: 685)

(f) a naturally occurring N-terminal flanking region of ITSM only intracellular domains selected from;

YKMYGSEMLHKRDPLDEDEDTDISYKKLKEEEMAD
(SEQ ID NO: 739)

CSRAARGTIGARRTGQPLKEDPSAVPVFSVDYGELDFQWREKTPEPPVPC

VPEQ (SEQ ID NO: 741)

RIRQKKAQGSTSSTRLHEPEKNAREITQDTNDITYADLNLPKGKKPAPQA

AEPNNH (SEQ ID NO: 743)

KTHRRKAARTAVGRNDTHPTTGSASPKHQKKSKLHGPTETSSCSGAAPTV

EMDEELHYASLNFHGMNPSKDTS (SEQ ID NO: 753)

KCYFLRKAKAKQMPVEMSRPAVPLLNSNNEKMSDPNMEANSHYGHNDDVR

NHAMKPINDNKEPLNSDVQYTEVQVSSAESHKDLGKKDTE
(SEQ ID NO: 765)

RRHQGKQNELSDTAGREINLVDAHLKSEQTEASTRQNSQVLLSETGIYDN

DPDLCFRMQEGSEVYSNPCLEENKPGIVYASLNHSVIGPNSRLARNVKEA

P (SEQ ID NO: 768)

WRMMKYQQKAAGMSPEQVLQPLEGDLCYADLTLQLAGTSPQKATTKLSSA

QVDQVEVEYVTMASLPKEDISYASLTLGAEDQEPTYCNMGHLSSHLPGRG

PEEP (SEQ ID NO: 771)

WRRKRKEKQSETSPKEFLTIYEDVKDLKTRRNHEQEQTFPGGGSTIYSMI

QSQSSAPTSQEPAYTLYSLIQPSRKSGSRKRNHSPSFNS
(SEQ ID NO: 780)

VRSCRKKSARPAAGVGDTGIEDANAVRGSASQGPLTEPWAEDSPPDQPPP

ASARSSVGEGELQYASLSFQMVKPWDSRGQEATD (SEQ ID NO: 759)

NKCGRRNKFGINRPAVLAPEDGLAMSLHFMTLGGSSLSPTEGKGSGLQGH

IIENPQYFSDACVHHIKRRDIVLKWELGEGAFGKVFLAECHNLLPEQDKM

LVAVKALKEASESARQDFQREAELLTMLQHQHIVRFFGVCTEGRPLLMVF

EYMRHGDLNRFLRSHGPDAKLLAGGEDVAPGPLGLGQLLAVASQVAAGMV

YLAGLHFVHRDLATRNCLVGQGLVVKIGDFGMSRDIYS
(SEQ ID NO: 782)

KLARHSKFGMKGPASVISNDDDSASPLHHISNGSNTPSSSEGGPDAVIIG

MTKIPVIENPQYFGITNSQLKPDTFVQHIKRHNIVLKRELGEGAFGKVFL

AECYNLCPEQDKILVAVKTLKDASDNARKDFHREAELLTNLQHEHIVKFY

GVCVEGDPLIMVFEYMKHGDLNKFLRAHGPDAVLMAEGNPPTELTQSQML

HIAQQIAAGMVYLASQHFVHRDLATRNCLVGENLLVKIGDFGMSRDVYS
(SEQ ID NO: 783)

KRKGRCSVPAFCSSQAEAPADTPEPTAGHTLYSVLSQGYEKLDTPLRPAR

QQPTPTSDSSSDSNLTTEEDEDRPEVHKPISGRYEVFDQVTQEGAGHDPA

PEGQADYDPVTPYVTEVESVVGENTMYAQVFNLQGKTPVSQKEESSA
(SEQ ID NO: 786)

KRVQETKFGNAFTEEDSELVVNYIAKKSFCRRAIELTLHSLGVSEELQNK

LEDVVIDRNLLILGKILGEGEFGSVMEGNLKQEDGTSLKVAVKTMKLDNS

SQREIEEFLSEAACMKDFSHPNVIRLLGVCIEMSSQGIPKPMVILPFMKY

GDLHTYLLYSRLETGPKHIPLQTLLKFMVDIALGMEYLSNRNFLHRDLAA

RNCMLRDDMTVCVADFGLSKKIYSGDYYRQGRIAKMPVKWIAIESLADRV

YTSKSDVWAFGVTMWEIATRGM (SEQ ID NO: 787)

(g) a naturally occurring intracellular domain between ITIM and ITSM from proteins that have ITIM.*ITSM motif selected from:

KEEEMAD (SEQ ID NO: 686)

NFHGMNPSKDTS (SEQ ID NO: 687)

-continued

QVSSAESHKDLGKKDTE (SEQ ID NO: 691)

NLPKGKKPAPQAAEPNNH (SEQ ID NO: 694)

NHSVIGPNSRLARNVKEAP (SEQ ID NO: 695)

DFQWREKTPEPPVPCVPEQ (SEQ ID NO: 696)

TLQLAGTSPQKATTKLSSAQVDQVEVEYVTMASLPKEDISYASLTLGAED

QEPTYCNMGHLSSHLPGRGPEEP (SEQ ID NO: 703)

ETGPKHIPLQTLLKFMVDIALGMEYLSNRNFLHRDLAARNCMLRDDMTVC

VADFGLSKKIYSGDYYRQGRIAKMPVKWIAIESLADRVYTSKSDVWAFGV

TMWEIATRGM (SEQ ID NO: 707)

(h) a naturally occurring intracellular domain from known inhibitory receptors selected from the sequences shown in table 2 wherein said intracellular domain is N-terminally flanking to a sequence in (f) or (g) above; and
(i) a non-naturally occurring sequence comprising between 1 and 500 amino acids; and 11. The N-CAR according to according to any one of embodiments 6 to 10 wherein L4 is absent or comprises one or more, preferably one, sequences selected from the group consisting of:

(j) a naturally occurring C-terminal flanking region of ITIM.*ITSM intracellular domains selected from:

SRP

RTQ

CVRS (SEQ ID NO: 809)

KAENIIMMETAQTSL (SEQ ID NO: 812)

RKAVPDAVESRYSRTEGSLDGT (SEQ ID NO: 815)

VFPSGMGTSSPARRGSADGPRSAQPLRPEDGHCSWPL
(SEQ ID NO: 817)

QTSPQPASEDTLTYADLDMVHLNRTPKQPAPKPEPSFSEYASVQVPRK
(SEQ ID NO: 818)

QNHEMYDYLLHGHRLKQPEDCLDELYEIMYSCWRTDPLDRPTFSVLRLQL

EKLLESLPDVRNQADVIYVNTQLLESSEGLAQGSTLAPLDLNIDPDSIIA

SCTPRAAISVVTAEVHDSKPHEGRYILNGGSEEWEDLTSAPSAAVTAEKN

SVLPGERLVRNGVSWSHSSMLPLGSSLPDELLFADDSSEGSEVLM
(SEQ ID NO: 830)

(k) a naturally occurring C-terminal flanking region of ITSM only intracellular domain selected from:

RTQ

SRP

KIHR (SEQ ID NO: 808)

CVRS (SEQ ID NO: 809)

KAENIIMMETAQTSL (SEQ ID NO: 812)

RKAVPDAVESRYSRTEGSLDGT (SEQ ID NO: 815)

RKPQVVPPPQQNDLEIPESPTYENFT (SEQ ID NO: 2028)

GKSQPKAQNPARLSRKELENFDVYS (SEQ ID NO: 2029)

VFPSGMGTSSPARRGSADGPRSAQPLRPEDGHCSWPL
(SEQ ID NO: 817)

QTSPQPASEDTLTYADLDMVHLNRTPKQPAPKPEPSFSEYASVQVPRK
(SEQ ID NO: 818)

FNLQGKTPVSQKEESSATIYCSIRKPQVVPPPQQNDLEIPESPTYENFT
(SEQ ID NO: 876)

GGRTMLPIRWMPPESILYRKFTTESDVWSFGVVLWEIFTYGKQPWYQLSN

TEAIDCITQGRELERPRACPPEVYAIMRGCWQREPQQRHSIKDVHARLQA

LAQAPPVYLDVLG (SEQ ID NO: 888)

GGHTMLPIRWMPPESIMYRKFTTESDVWSLGVVLWEIFTYGKQPWYQLSN

NEVIECITQGRVLQRPRTCPQEVYELMLGCWQREPHMRKNIKGIHTLLQN

LAKASPVYLDILG (SEQ ID NO: 889)

QNHEMYDYLLHGHRLKQPEDCLDELYEIMYSCWRTDPLDRPTFSVLRLQL

EKLLESLPDVRNQADVIYVNTQLLESSEGLAQGSTLAPLDLNIDPDSIIA

SCTPRAAISVVTAEVHDSKPHEGRYILNGGSEEWEDLTSAPSAAVTAEKN

SVLPGERLVRNGVSWSHSSMLPLGSSLPDELLFADDSSEGSEVLM
(SEQ ID NO: 830)

KDLKTRRNHEQEQTFPGGGSTIYSMIQSQSSAPTSQEPAYTLYSLIQPSR

KSGSRKRNHSPSFNSTIYEVIGKSQPKAQNPARLSRKELENFDVYS
(SEQ ID NO: 902)

(l) a naturally occurring intracellular domain from a known inhibitory receptor selected from the sequences shown in table 2 wherein said intracellular domain is C-terminally flanking to a sequence in (j) or (k) above; and (m) a non-naturally occurring sequence comprising between 1 and 500 amino acids.

11.1. The N-CAR according to embodiment 6 wherein the intracellular domain comprises the following sequence:

$((L1\text{-}ITIM\text{-}L2)^n\text{-}(L3\text{-}ITSM\text{-}L4)^m)^p$, wherein n is 0;

m is 1;

p is 1;

L3 comprises one sequence selected from (f) a naturally occurring N-terminal flanking region of an ITSM only intracellular domain such as, for example, any of the sequences shown in Table 6 below or a fragment thereof; or, (i) a non-naturally occurring sequence comprising between 1 and 500 amino acids; and L4 comprises one or more, preferably one or two, sequences selected from the group consisting of:

(k) a naturally occurring C-terminal flanking region of an ITSM only intracellular domain such as, for example, any of the sequences shown in Table 8 below or a fragment thereof;

(l) a naturally occurring intracellular domain from a known inhibitory receptor such as any of the sequences shown in table 2 or a fragment thereof wherein said intracellular domain is C-terminally flanking to a sequence in (k) above; and (m) a non-naturally occurring sequence comprising between 1 and 500 amino acids, and, wherein.

11.2. The N-CAR according to embodiment 6 wherein the intracellular domain comprises the following sequence:

((L1-ITIM-L2)$^n$-(L3-ITSM-L4)$^m$)$^p$, wherein n is 0;

m is 1;

p is 1;

L3 is selected from

YKMYGSEMLHKRDPLDEDEDTDISYKKLKEEEMAD (SEQ ID NO: 739)

CSRAARGTIGARRTGQPLKEDPSAVPVFSVDYGELDFQWREKTPEPPVPCVPEQ (SEQ ID NO: 741)

RIRQKKAQGSTSSTRLHEPEKNAREITQDTNDITYADLNLPKGKKPAPQAAEPNNH (SEQ ID NO: 743)

KTHRRKAARTAVGRNDTHPTTGSASPKHQKKSKLHGPTETSSCSGAAPTVEMDEELHYASLNFHGMNPSKDTS (SEQ ID NO: 753)

KCYFLRKAKAKQMPVEMSRPAVPLLNSNNEKMSDPNMEANSHYGHNDDVRNHAMKPINDNKEPLNSDVQYTEVQVSSAESHKDLGKKDTE (SEQ ID NO: 765)

RRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAP (SEQ ID NO: 768)

WRMMKYQQKAAGMSPEQVLQPLEGDLCYADLTLQLAGTSPQKATTKLSSAQVDQVEVEYVTMASLPKEDISYASLTLGAEDQEPTYCNMGHLSSHLPGRGPEEP (SEQ ID NO: 771)

WRRKRKEKQSETSPKEFLTIYEDVKDLKTRRNHEQEQTFPGGGSTIYSMIQSQSSAPTSQEPAYTLYSLIQPSRKSGSRKRNHSPSFNS (SEQ ID NO: 780)

VRSCRKKSARPAAGVGDTGIEDANAVRGSASQGPLTEPWAEDSPPDQPPPASARSSVGEGELQYASLSFQMVKPWDSRGQEATD (SEQ ID NO: 759)

NKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYS (SEQ ID NO: 782)

KLARHSKFGMKGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYS (SEQ ID NO: 783)

KRKGRCSVPAFCSSQAEAPADTPEPTAGHTLYSVLSQGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQGKTPVSQKEESSA (SEQ ID NO: 786)

KRVQETKFGNAFTEEDSELVVNYIAKKSFCRRAIELTLHSLGVSEELQNKLEDVVIDRNLLILGKILGEGEFGSVMEGNLKQEDGTSLKVAVKTMKLDNSSQREIEEFLSEAACMKDFSHPNVIRLLGVCIEMSSQGIPKPMVILPFMKYGDLHTYLLYSRLETGPKHIPLQTLLKFMVDIALGMEYLSNRNFLHRDLAARNCMLRDDMTVCVADFGLSKKIYSGDYYRQGRIAKMPVKWIAIESLADRVYTSKSDVWAFGVTMWEIATRGM (SEQ ID NO: 787)

and L4 comprises one sequence selected from the group consisting of (k)

RTQ

SRP

KIHR (SEQ ID NO: 808)

CVRS (SEQ ID NO: 809)

KAENIIMMETAQTSL (SEQ ID NO: 812)

RKAVPDAVESRYSRTEGSLDGT (SEQ ID NO: 815)

RKPQVVPPPQQNDLEIPESPTYENFT (SEQ ID NO: 2028)

GKSQPKAQNPARLSRKELENFDVYS (SEQ ID NO: 2029)

VFPSGMGTSSPARRGSADGPRSAQPLRPEDGHCSWPL (SEQ ID NO: 817)

QTSPQPASEDTLTYADLDMVHLNRTPKQPAPKPEPSFSEYASVQVPRK (SEQ ID NO: 818)

FNLQGKTPVSQKEESSATIYCSIRKPQVVPPPQQNDLEIPESPTYENFT (SEQ ID NO: 876)

GGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG (SEQ ID NO: 888)

GGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG (SEQ ID NO: 889)

QNHEMYDYLLHGHRLKQPEDCLDELYEIMYSCWRTDPLDRPTFSVLRLQLEKLLESLPDVRNQADVIYVNTQLLESSEGLAQGSTLAPLDLNIDPDSIIASCTPRAAISVVTAEVHDSKPHEGRYILNGGSEEWEDLTSAPSAAVTAEKNSVLPGERLVRNGVSWSHSSMLPLGSSLPDELLFADDSSEGSEVLM (SEQ ID NO: 830)

KDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS (SEQ ID NO: 902)

and optionally (l) a naturally occurring intracellular domain from a known inhibitory receptor such as any of the sequences shown in table 2 or a fragment thereof wherein said intracellular domain is C-terminally flanking to a sequence in (k) above.

11.3. The N-CAR according to embodiment 6 wherein the intracellular domain comprises the following sequence:
((L1-ITIM-L2)$^n$-(L3-ITSM-L4)$^m$)$^p$, wherein
n is 0;
m is 1;
p is 1;
L3 is selected from

```
CSRAARGTIGARRTGQPLKEDPSAVPVFSVDYGELDFQWREKTPEPPVPC

VPEQ (SEQ ID NO: 741)

RIRQKKAQGSTSSTRLHEPEKNAREITQDTNDITYADLNLPKGKKPAPQA

AEPNNH (SEQ ID NO: 743)

KCYFLRKAKAKQMPVEMSRPAVPLLNSNNEKMSDPNMEANSHYGHNDDVR

NHAMKPINDNKEPLNSDVQYTEVQVSSAESHKDLGKKDTE
(SEQ ID NO: 765)

RRHQGKQNELSDTAGREINLVDAHLKSEQTEASTRQNSQVLLSETGIYDN

DPDLCFRMQEGSEVYSNPCLEENKPGIVYASLNHSVIGPNSRLARNVKEA

P (SEQ ID NO: 768)

WRMMKYQQKAAGMSPEQVLQPLEGDLCYADLTLQLAGTSPQKATTKLSSA

QVDQVEVEYVTMASLPKEDISYASLTLGAEDQEPTYCNMGHLSSHLPGRG

PEEP (SEQ ID NO: 771)

WRRKRKEKQSETSPKEFLTIYEDVKDLKTRRNHEQEQTFPGGGSTIYSMI

QSQSSAPTSQEPAYTLYSLIQPSRKSGSRKRNHSPSFNS
(SEQ ID NO: 780)

VRSCRKKSARPAAGVGDTGIEDANAVRGSASQGPLTEPWAEDSPPDQPPP

ASARSSVGEGELQYASLSFQMVKPWDSRGQEATD (SEQ ID NO: 759)

KRKGRCSVPAFCSSQAEAPADTPEPTAGHTLYSVLSQGYEKLDTPLRPAR

QQPTPTSDSSSDSNLTTEEDEDRPEVHKPISGRYEVFDQVTQEGAGHDPA

PEGQADYDPVTPYVTEVESVVGENTMYAQVFNLQGKTPVSQKEESSA
(SEQ ID NO: 786)
```

L4 comprises one sequence selected from the group consisting of
(k)

```
SRP

KIHR (SEQ ID NO: 808)

CVRS (SEQ ID NO: 809)

RKAVPDAVESRYSRTEGSLDGT (SEQ ID NO: 815)

RKPQVVPPPQQNDLEIPESPTYENFT (SEQ ID NO: 2028)

GKSQPKAQNPARLSRKELENFDVYS (SEQ ID NO: 2029)

VFPSGMGTSSPARRGSADGPRSAQPLRPEDGHCSWPL
(SEQ ID NO: 817)

QTSPQPASEDTLTYADLDMVHLNRTPKQPAPKPEPSFSEYASVQVPRK
(SEQ ID NO: 818)
``` and optionally
(l) a naturally occurring intracellular domain from a known inhibitory receptor selected from the sequences shown in table 2, preferably KIR2DL2, or a fragment thereof wherein said intracellular domain is C-terminally flanking to a sequence in (k) above.

11.4. The N-CAR according to embodiment 6 wherein the intracellular domain comprises the following sequence:
((L1-ITIM-L2)$^n$-(L3-ITSM-L4)$^m$)$^p$, wherein
n is 0;
m is 1;
p is 1;
L3 is selected from

```
CSRAARGTIGARRTGQPLKEDPSAVPVFSVDYGELDFQWREKTPEPPVPC

VPEQ (SEQ ID NO: 741)
``` and L4 comprises
(k)

```
VFPSGMGTSSPARRGSADGPRSAQPLRPEDGHCSWPL
(SEQ ID NO: 817)
``` and
(l) a naturally occurring intracellular domain from a known inhibitory receptor selected from the sequences shown in table 2, preferably KIR2DL2, or a fragment thereof wherein said intracellular domain is C-terminally flanking to a sequence in (k) above.

11.5. The N-CAR according to embodiment 6 wherein the intracellular domain comprises the following sequence:
((L1-ITIM-L2)$^n$-(L3-ITSM-L4)$^m$)$^p$, wherein
n is 0;
m is 1;
p is 1;
L3 is selected from

```
WRMMKYQQKAAGMSPEQVLQPLEGDLCYADLTLQLAGTSPQKATTKLSSA

QVDQVEVEYVTMASLPKEDISYASLTLGAEDQEPTYCNMGHLSSHLPGRG

PEEP (SEQ ID NO: 771)
```

L4 comprises a sequence selected from
(k)

```
SRP
``` and optionally
(l) a naturally occurring intracellular domain from a known inhibitory receptor selected from the sequences shown in table 2 or a fragment thereof wherein said intracellular domain is C-terminally flanking to a sequence in (k) above.

11.6. The N-CAR according to embodiment 6 wherein the intracellular domain comprises the following sequence:
((L1-ITIM-L2)$^n$-(L3-ITSM-L4)$^m$)$^p$, wherein
n is 0;
m is 1;
p is 1 or 2;
L3 comprises one sequence selected from
(i) a non-naturally occurring sequence comprising between 1 and 500 amino acids; and
L4 comprises one or more, preferably one or two, sequences selected from:
(m) a non-naturally occurring sequence comprising between 1 and 500 amino acids.

11.7. The N-CAR according to embodiment 6 wherein the intracellular domain is selected from SEQ ID No 2000, SEQ ID No 2001, SEQ ID No 2002, SEQ ID No 2003, SEQ ID No 2004, SEQ ID No 2005, SEQ ID No 2006, SEQ ID No 2007, SEQ ID No 2008, SEQ ID No 2009, SEQ ID No 2010, SEQ ID No 2011, SEQ ID No 2012, SEQ ID No 2013, SEQ ID No 2014, SEQ ID No 2015, SEQ ID No 2016 and SEQ ID No 2017.

12. The N-CAR according to any one of embodiments 6 to 11.7 wherein the non-naturally occurring sequence of (d), (i) and (m) comprises between 1 and 400, 1 and 300, 1 and 200, 1 and 100, 10 and 100, 10 and 80, 10 and 60, 10 and 40, 100 and 200, 100 and 300 or 100 and 400.

13. The N-CAR according to any one of embodiments 6 to 11.7 wherein the non-naturally occurring sequence of (d) or (i) is a Glycine/Serine linker (Gly$_x$Ser)$_n$ where x=1, 2, 3, 4 or 5 and n is 1 to 100 (SEQ ID NO: 2037).

14. The N-CAR according to embodiment 13 wherein the non-naturally occurring sequence of (d) or (i) is a Glycine/Serine linker (Gly-Gly-Gly-Ser)$_n$ (SEQ ID NO: 2044) or (Gly-Gly-Gly-Gly-Ser)$_n$ (SEQ ID NO: 2045), where n is 1 to 100, 1 to 80, 1 to 50, 1 to 20 or 1 to 10.

15. The N-CAR according to embodiment 14 wherein the non-naturally occurring sequence of (d) or (i) is a (Gly$_4$Ser)$_4$ (SEQ ID NO: 2032) or (Gly$_4$Ser)$_3$ (SEQ ID NO: 2033). 16. The ICAR according to any one of embodiments 6 to 15 wherein the intracellular domain comprises the sequence (L1-ITIM-L2-L3-ITSM-L4)$^p$ wherein p is 1, 2, 3, 4 or 5;

L1 is a naturally occurring N-terminal flanking region of ITIM only intracellular domains selected from the following sequences;

YKMYGSEMLHKRDPLDEDEDTD (SEQ ID NO: 4)

DHWALTQRTARAVSPQSTKPMAES (SEQ ID NO: 194)

CSRAARGTIGARRTGQPLKEDPSAVPVFS (SEQ ID NO: 7)

HRQNQIKQGPPRSKDEEQKPQQRPDLAVDVLERTADKATVNGLPEKDRET
DTSALAAGSSQE (SEQ ID NO: 268)

KTHRRKAARTAVGRNDTHPTTGSASPKHQKKSKLHGPTETSSCSGAAPTV
EMDEE (SEQ ID NO: 12)

LTRKKKALRIHSVEGDLRRKSAGQEEWSPSAPSPPGSCVQAEAAPAGLCG
EQRGEDCAELHDYFNV (SEQ ID NO: 307)

KCYFLRKAKAKQMPVEMSRPAVPLLNSNNEKMSDPNMEANSHYGHNDDVR
NHAMKPINDNKEPLNSD (SEQ ID NO: 18)

RRHQGKQNELSDTAGREINLVDAHLKSEQTEASTRQNSQVLLSETGIYDN
DPDLCFRMQEGSEVYSNPCLEENKPG (SEQ ID NO: 20)

WRMMKYQQKAAGMSPEQVLQPLEGDLCYADLTLQLAGTSPQKATTKLSSA
QVDQVEVEYVTMASLPKED (SEQ ID NO: 347)

KRVQETKFGNAFTEEDSELVVNYIAKKSFCRRAIELTLHSLGVSEELQNK

LEDVVIDRNLLILGKILGEGEFGSVMEGNLKQEDGTSLKVAVKTMKLDNS

SQREIEEFLSEAACMKDFSHPNVIRLLGVCIEMSSQGIPKPMVILPFMKY

GDLHTY (SEQ ID NO: 26)

L2 is absent;

L3 is a naturally occurring intracellular domain between ITIM and ITSM from proteins that have ITIM.*ITSM motif selected from the following sequences:

KEEEMAD (SEQ ID NO: 686)

NFHGMNPSKDTS (SEQ ID NO: 687)

QVSSAESHKDLGKKDTE (SEQ ID NO: 691)

NLPKGKKPAPQAAEPNNH (SEQ ID NO: 694)

NHSVIGPNSRLARNVKEAP (SEQ ID NO: 695)

DFQWREKTPEPPVPCVPEQ (SEQ ID NO: 696)

TLQLAGTSPQKATTKLSSAQVDQVEVEYVTMASLPKEDISYASLTLGAED
QEPTYCNMGHLSSHLPGRGPEEP (SEQ ID NO: 703)

ETGPKHIPLQTLLKFMVDIALGMEYLSNRNFLHRDLAARNCMLRDDMTVC

AVDFGLSKKIYSGDYYRQGRIAKMPVKWIAIESLADRVYTSKSDVWAFGV

TMWEIATRGM (SEQ ID NO: 707)

L4 is a naturally occurring C-terminal flanking region of ITIM.*ITSM intracellular domains selected from the following sequences:

SRP

RTQ

CVRS (SEQ ID NO: 809)

KAENIIMMETAQTSL (SEQ ID NO: 812)

RKAVPDAVESRYSRTEGSLDGT (SEQ ID NO: 815)

VFPSGMGTSSPARRGSADGPRSAQPLRPEDGHCSWPL
(SEQ ID NO: 817)

QTSPQPASEDTLTYADLDMVHLNRTPKQPAPKPEPSFSEYASVQVPRK
(SEQ ID NO: 818)

QNHEMYDYLLHGHRLKQPEDCLDELYEIMYSCWRTDPLDRPTFSVLRLQL

EKLLESLPDVRNQADVIYVNTQLLESSEGLAQGSTLAPLDLNIDPDSIIA

SCTPRAAISVVTAEVHDSKPHEGRYILNGGSEEWEDLTSAPSAAVTAEKN

SVLPGERLVRNGVSWSHSSMLPLGSSLPDELLFADDSSEGSEVLM
(SEQ ID NO: 830)

or a naturally occurring C-terminal flanking region of ITSM only intracellular domains selected from the following sequences:

```
RTQ

SRP

CVRS (SEQ ID NO: 809)

KAENIIMMETAQTSL (SEQ ID NO: 812)

RKAVPDAVESRYSRTEGSLDGT (SEQ ID NO: 815)

VFPSGMGTSSPARRGSADGPRSAQPLRPEDGHCSWPL
(SEQ ID NO: 817)

QTSPQPASEDTLTYADLDMVHLNRTPKQPAPKPEPSFSEYASVQVPRK
(SEQ ID NO: 876)

FNLQGKTPVSQKEESSATIYCSIRKPQVVPPPQQNDLEIPESPTYENFT
(SEQ ID NO: 741)

GGRTMLPIRWMPPESILYRKFTTESDVWSFGVVLWEIFTYGKQPWYQLSN

TEAIDCITQGRELERPRACPPEVYAIMRGCWQREPQQRHSIKDVHARLQA

LAQAPPVYLDVLG (SEQ ID NO: 888)

GGHTMLPIRWMPPESIMYRKFTTESDVWSLGVVLWEIFTYGKQPWYQLSN

NEVIECITQGRVLQRPRTCPQEVYELMLGCWQREPHMRKNIKGIHTLLQN

LAKASPVYLDILG (SEQ ID NO: 889)

QNHEMYDYLLHGHRLKQPEDCLDELYEIMYSCWRTDPLDRPTFSVLRLQL

EKLLESLPDVRNQADVIYVNTQLLESSEGLAQGSTLAPLDLNIDPDSIIA

SCTPRAAISVVTAEVHDSKPHEGRYILNGGSEEWEDLTSAPSAAVTAEKN

SVLPGERLVRNGVSWSHSSMLPLGSSLPDELLFADDSSEGSEVLM
(SEQ ID NO: 830)

KDLKTRRNHEQEQTFPGGGSTIYSMIQSQSSAPTSQEPAYTLYSLIQPSR

KSGSRKRNHSPSFNSTIYEVIGKSQPKAQNPARLSRKELENFDVYS
(SEQ ID NO: 902).
```

17. The N-CAR according to any one of the preceding embodiments wherein the term amino acid refers to glycine, alanine, valine, leucine, isoleucine, phenylalanine, proline, serine, threonine, tyrosine, cysteine, methionine, lysine, arginine, histidine, tryptophan, aspartic acid, glutamic acid, asparagine or glutamine.

18. The N-CAR according to any one of the preceding embodiments wherein $X_1$ is E, V or I.

19. The N-CAR any one of the preceding embodiments wherein $X_1$ is E.

20. The N-CAR any one of the preceding embodiments wherein $X_2$ is S or A.

21. The N-CAR any one of the preceding embodiments wherein $X_2$ is A.

22. The N-CAR any one of the preceding embodiments wherein $X_3$ is E, S, T, Q or V.

23. The N-CAR any one of the preceding embodiments wherein $X_3$ is E.

24. The N-CAR any one of the preceding embodiments wherein $X_3$ is T.

25. The N-CAR any one of the preceding embodiments wherein $X_2$ is I.

26. The N-CAR according to any one of embodiments 7 to 25 wherein $X_5$ is L, V or I 27. The N-CAR according to any one of embodiments 7 to 26 wherein $X_5$ is L.

28. The N-CAR according to any one of embodiments 7 to 26 wherein $X_5$ is V

29. The N-CAR according to any one of embodiments 7 to 26 wherein $X_5$ is I.

30. The N-CAR according to any one of embodiments 7 to 29 wherein $X_6$ is A, H, Q, T, D, V, L or E.

31. The N-CAR according to any one of embodiments 7 to 30 wherein $X_6$ is H.

32. The N-CAR according to any one of embodiments 7 to 30 wherein $X_6$ is D.

33. The N-CAR according to any one of embodiments 7 to 32 wherein $X_7$ is A, G, T, V or E.

34. The N-CAR according to any one of embodiments 7 to 33 wherein $X_7$ is A.

35. The N-CAR according to any one of embodiments 7 to 33 wherein $X_7$ is G.

36. The N-CAR according to any one of embodiments 7 to 35 wherein $X_8$ is V, S, D or E.

37. The N-CAR according to any one of embodiments 7 to 36 wherein $X_8$ is S or E.

38. The N-CAR according to any one of embodiments 7 to 37 wherein $X_8$ is E.

39. The N-CAR according to any one of embodiments 7 to 38 wherein $X_9$ is L or V.

40. The N-CAR according to any one of embodiments 7 to 38 wherein $X_9$ is L.

41. The N-CAR according to any one of embodiments 7 to 40 wherein $X_5$ is L or V, $X_8$ is E and $X_9$ is L.

42. The N-CAR any one of the preceding embodiments wherein the ITSM, or at least one of the ITSMs when several ITSMs are present in the intracellular domain, is selected from TAYELV (SEQ ID NO: 86), TAYGLI (SEQ ID NO: 927), TAYNAV (SEQ ID NO: 928), TCYGLV (SEQ ID NO: 929), TCYPDI (SEQ ID NO: 930), TDYASI (SEQ ID NO: 931), TDYDLV (SEQ ID NO: 932), TDYLSI (SEQ ID NO: 933), TDYQQV (SEQ ID NO: 934), TDYYRV (SEQ ID NO: 935), TEYASI (SEQ ID NO: 936), TEYATI (SEQ ID NO: 937), TEYDTI (SEQ ID NO: 938), TEYPLV (SEQ ID NO: 939), TEYSEI (SEQ ID NO: 940), TEYSEV (SEQ ID NO: 941), TEYSTI (SEQ ID NO: 942), TEYTKV (SEQ ID NO: 943), TFYHW (SEQ ID NO: 944), TFYLLI (SEQ ID NO: 945), TFYNKI (SEQ ID NO: 946), TFYPDI (SEQ ID NO: 947), TGYEDV (SEQ ID NO: 948), TGYLSI (SEQ ID NO: 949), THYKEI (SEQ ID NO: 950), TIYAQV (SEQ ID NO: 951), TIYAW (SEQ ID NO: 952), TIYCSI (SEQ ID NO: 953), TIYEDV (SEQ ID NO: 954), TIYERI (SEQ ID NO: 955), TIYEVI (SEQ ID NO: 956), TIYHVI (SEQ ID NO: 957), TIYIGV (SEQ ID NO: 958), TIYLKV (SEQ ID NO: 959), TIYSMI (SEQ ID NO: 960), TIYSTI (SEQ ID NO: 961), TIYTYI (SEQ ID NO: 962), TKYFHI (SEQ ID NO: 963), TKYMEI (SEQ ID NO: 964), TKYQSV (SEQ ID NO: 965), TKYSNI (SEQ ID NO: 966), TKYSTV (SEQ ID NO: 967), TLYASV (SEQ ID NO: 968), TLYAW (SEQ ID NO: 969), TLYFWV (SEQ ID NO: 970), TLYHLV (SEQ ID NO: 971), TLYPMV (SEQ ID NO: 972), TLYPPI (SEQ ID NO: 973), TLYRDI (SEQ ID NO: 974), TLYRDV (SEQ ID NO: 975), TLYSKI (SEQ ID NO: 976), TLYSLI (SEQ ID NO: 977), TLYSPV (SEQ ID NO: 978), TMYAQV (SEQ ID NO: 979), TMYCQV (SEQ ID NO: 980), TNYKAV (SEQ ID NO: 981), TNYNLV (SEQ ID NO: 982), TPYAGI (SEQ ID NO: 983), TPYPGV (SEQ ID NO: 984), TPYVDI (SEQ ID NO: 985), TQYGRV (SEQ ID NO: 986), TQYNQV (SEQ ID NO: 987), TRYAYV (SEQ ID NO: 988), TRYGEV (SEQ ID NO: 989), TRYHSV (SEQ ID NO: 990), TRYKTI (SEQ ID NO: 991), TRYLAI (SEQ ID NO: 992), TRYMAI (SEQ ID NO: 993), TRYQKI (SEQ ID NO: 994), TRYQQI (SEQ ID NO: 995), TRYSNI (SEQ ID NO: 996), TRYSPI (SEQ ID NO: 997), TSYGTV (SEQ ID NO: 998), TSYMEV (SEQ ID NO: 999), TSYQGV (SEQ ID NO: 1000), TSYTTI (SEQ ID NO: 1001), TTYRSI (SEQ ID NO: 1002), TTYSDV (SEQ ID NO: 1003), TTYVTI (SEQ ID NO: 1004), TVYAQI (SEQ ID NO: 1005), TVYASV (SEQ ID NO: 1006), TVYEVI (SEQ ID NO: 1007), TVYGDV (SEQ ID NO: 1008), TVYKGI (SEQ ID NO: 1009), TVYQRV (SEQ ID NO: 1010), TVYSEV (SEQ ID NO: 1011), TVYSTV (SEQ ID NO: 1012), TYYHSI (SEQ ID NO: 1013), TYYLQI (SEQ ID NO: 1014), or TYYYSV (SEQ ID NO: 1015).

43. The N-CAR any one of the preceding embodiments wherein the ITSM, or at least one of the ITSMs when several ITSMs are present in the intracellular domain is TEYASI (SEQ ID NO: 936).

44. The N-CAR any one of the preceding embodiments wherein the ITSM, or at least one of the ITSMs when several ITSMs are present in the intracellular domain is TEYSEI (SEQ ID NO: 940).

44.1 The N-CAR any one of the preceding embodiments wherein the ITSM, or at least one of the ITSMs when several ITSMs are present in the intracellular domain is TEYSTI (SEQ ID NO: 942).

45. The N-CAR any one of the preceding embodiments wherein the ITSM, or at least one of the ITSMs when several ITSMs are present in the intracellular domain is TVYSEV (SEQ ID NO: 1011).

46. The N-CAR according to any one of embodiments 7 to 45 wherein the ITIM, or at least one of the ITIMs when several ITSMs are present in the intracellular domain is selected from LSYRSL (SEQ ID NO: 1496), LPYYDL (SEQ ID NO: 1378), LPYYDL (SEQ ID NO: 1378), LLYSRL (SEQ ID NO: 1334), LLYSRL (SEQ ID NO: 1334), LIYTLL (SEQ ID NO: 1283), LLYADL (SEQ ID NO: 1303), ISYTTL (SEQ ID NO: 1116), VTYSAL (SEQ ID NO: 1982), IHYSEL (SEQ ID NO: 1059), VDYVIL (SEQ ID NO: 1832), LHYASL (SEQ ID NO: 1218), LDYDYL (SEQ ID NO: 1174), VDYDFL (SEQ ID NO: 1817), VTYSTL (SEQ ID NO: 1983), IIYSEV (SEQ ID NO: 1065), LEYLCL (SEQ ID NO: 1186), VLYGQL (SEQ ID NO: 1901), VPYTPL (SEQ ID NO: 1926), ISYPML (SEQ ID NO: 1115), ISYPML (SEQ ID NO: 1115), ISYPML (SEQ ID NO: 1115), VSYTNL (SEQ ID NO: 1965), LLYEMV (SEQ ID NO: 1016), VDYNLV (SEQ ID NO: 1825), ITYFAL (SEQ ID NO: 1017), VHYQSV (SEQ ID NO: 1859), VPYVMV (SEQ ID NO: 1929), IPYRTV (SEQ ID NO: 1089), IAYSLL (SEQ ID NO: 1026), VCYGRL (SEQ ID NO: 1813), LKYLYL (SEQ ID NO: 1294), LLYEHV (SEQ ID NO: 1307), ITYSLL (SEQ ID NO: 1125), VLYSEL (SEQ ID NO: 1905), IWYNIL (SEQ ID NO: 1140), ISYKGL (SEQ ID NO: 1018), IDYYNL (SEQ ID NO: 1035), LEYLQL (SEQ ID NO: 1189), LKYRGL (SEQ ID NO: 1301), VLYASV (SEQ ID NO: 1893), LQYLSL (SEQ ID NO: 1386), LFYRHL (SEQ ID NO: 1201), VQYKAV (SEQ ID NO: 1931), LSYSSL (SEQ ID NO: 1499), LSYTKV (SEQ ID NO: 1501), VQYSTV (SEQ ID NO: 1936), VKYNPV (SEQ ID NO: 1882), VVYSEV (SEQ ID NO: 1992), VVYSEV (SEQ ID NO: 1992), IIYSEV (SEQ ID NO: 1065), LEYVSV (SEQ ID NO: 1192), LAYHTV (SEQ ID NO: 1019), VQYLRL (SEQ ID NO: 1020), VTYTQL (SEQ ID NO: 1985), IVYTEL (SEQ ID NO: 1136), VTYTQL (SEQ ID NO: 1985), IVYAEL (SEQ ID NO: 1126), VTYAQL (SEQ ID NO: 1974), IVYTEL (SEQ ID NO: 1136), VTYAQL (SEQ ID NO: 1974), IVYTEL (SEQ ID NO: 1136), VTYAQL (SEQ ID NO: 1974), VTYAQL (SEQ ID NO: 1974), VTYAQL (SEQ ID NO: 1974), VTYAQL (SEQ ID NO: 1974), ILYTEL (SEQ ID NO: 1080), VTYAQL (SEQ ID NO: 1974), VTYAQL (SEQ ID NO: 1974), ITYAAV (SEQ ID NO: 1117), VTYAQL (SEQ ID NO: 1974), ITYAAV (SEQ ID NO: 1117), VIYIDV (SEQ ID NO: 1866), VTYAEV (SEQ ID NO: 1971), VTYAQL (SEQ ID NO: 1974), VTYAQL (SEQ ID NO: 1974), VTYAPV (SEQ ID NO: 1973), VTYAQL (SEQ ID NO: 1974), VTYAKV (SEQ ID NO: 1972), VTYARL (SEQ ID NO: 2038), VTYAQL (SEQ ID NO: 1974), ILYHTV (SEQ ID NO: 1076), LLYSRL (SEQ ID NO: 1334), VLYAML (SEQ ID NO: 1892), VIYAQL (SEQ ID NO: 1861), LVYENL (SEQ ID NO: 1527), LCYADL (SEQ ID NO: 1159), ISYASL (SEQ ID NO: 1108), LTYVLL (SEQ ID NO: 1021), VTYVNL (SEQ ID NO: 1986), VRYSIV (SEQ ID NO: 1022), VFYRQV (SEQ ID NO: 1845), VFYRQV (SEQ ID NO: 1845), LKYMEV (SEQ ID NO: 1295), LKYMEV (SEQ ID NO: 1295), VDYGEL (SEQ ID NO: 1820), LSYMDL (SEQ ID NO: 1487), VLYTAV (SEQ ID NO: 1907), VQYTEV (SEQ ID NO: 1937), IVYASL (SEQ ID NO: 1128), VEYLEV (SEQ ID NO: 1838), LEYVDL (SEQ ID NO: 1191), ITYADL (SEQ ID NO: 1118), LTYADL (SEQ ID NO: 1505), ITYADL (SEQ ID NO: 1118), LTYADL (SEQ ID NO: 1505), VIYENV (SEQ ID NO: 1863), VIYENV (SEQ ID NO: 1863), VIYENV (SEQ ID NO: 1863), VIYENV (SEQ ID NO: 1863), LAYYTV (SEQ ID NO: 1158), VSYSAV (SEQ ID NO: 1960), LVYDKL (SEQ ID NO: 1525), LNYMVL (SEQ ID NO: 1356), LNYACL (SEQ ID NO: 1351), LDYINV (SEQ ID NO: 1177), LHYATL (SEQ ID NO: 1221), LHYASL (SEQ ID NO: 1218), LHYASL (SEQ ID NO: 1218), LHYAVL (SEQ ID NO: 1222), IQYAPL (SEQ ID NO: 1093), IQYASL (SEQ ID NO: 1094), IQYASL (SEQ ID NO: 1094), LLYLLL (SEQ ID NO: 1023), VVYSQV (SEQ ID NO: 1993), VIYSSV (SEQ ID NO: 1873), VVYSQV (SEQ ID NO: 1993), VIYSSV (SEQ ID NO: 1873), VVYYRV (SEQ ID NO: 2039), VPYVEL (SEQ ID NO: 1928), LDYDKL (SEQ ID NO: 1173), LPYYDL (SEQ ID NO: 1378), LSYPVL (SEQ ID NO: 1492), VAYSQV (SEQ ID NO: 1810), LFYWDV (SEQ ID NO: 1203), LFYWDV (SEQ ID NO: 1203), LIYSQV (SEQ ID NO: 2040), or LDYEFL (SEQ ID NO: 1176).

47. The N-CAR according to any one of embodiments 7 to 45 wherein the ITIM, or at least one of the ITIMs when several ITSMs are present in the intracellular domain is selected IAYGDI (SEQ ID NO: 1024), IAYRDL (SEQ ID NO: 1025), IAYSLL (SEQ ID NO: 1026), IAYSRL (SEQ ID NO: 1027), ICYALL (SEQ ID NO: 1028), ICYDAL (SEQ ID NO: 1029), ICYPLL (SEQ ID NO: 1030), ICYQLI (SEQ ID NO: 1031), IDYILV (SEQ ID NO: 1032), IDYKTL (SEQ ID NO: 1033), IDYTQL (SEQ ID NO: 1034), IDYYNL (SEQ ID NO: 1035), IEYCKL (SEQ ID NO: 1036), IEYDQI (SEQ ID NO: 1037), IEYGPL (SEQ ID NO: 1038), IEYIRV (SEQ ID NO: 1039), IEYKSL (SEQ ID NO: 1040), IEYKTL (SEQ ID NO: 1041), IEYSVL (SEQ ID NO: 1042), IEYWGI (SEQ ID NO: 1043), IFYGNV (SEQ ID NO: 1044), IFYHNL (SEQ ID NO: 1045), IFYKDI (SEQ ID NO: 1046), IFYQNV (SEQ ID NO: 1047), IFYRLI (SEQ ID NO: 1048), IGYDIL (SEQ ID NO: 1049), IGYDVL (SEQ ID NO: 1050), IGYICL (SEQ ID NO: 1051), IGYKAI (SEQ ID NO: 1052), IGYLEL (SEQ ID NO: 1053), IGYLPL (SEQ ID NO: 1054), IGYLRL (SEQ ID NO: 1055), IGYPFL (SEQ ID NO: 1056), IGYSDL (SEQ ID NO: 1057), IHYRQI (SEQ ID NO: 1058), IHYSEL (SEQ ID NO: 1059), IIYAFL (SEQ ID NO: 1060), IIYHVI (SEQ ID NO: 1061), IIYMFL (SEQ ID NO: 1062), IIYNLL (SEQ ID NO: 1063), IIYNNL (SEQ ID NO: 1064), IIYSEV (SEQ ID NO: 1065), IKYCLV (SEQ ID NO: 1066), IKYKEL (SEQ ID NO: 1067), IKYLAL (SEQ ID NO: 1068), IKYTCI (SEQ ID NO: 1069), ILYADI (SEQ ID NO: 1070), ILYAFL (SEQ ID NO: 1071), ILYCSV (SEQ ID NO: 1072), ILYEGL (SEQ ID NO: 1073), ILYELL (SEQ ID NO: 1074), ILYFQI (SEQ ID NO: 1075), ILYHTV (SEQ ID NO: 1076), ILYLQV (SEQ ID NO: 1077), ILYSIL (SEQ ID NO: 1078), ILYSVL (SEQ ID NO: 1079), ILYTEL (SEQ ID NO: 1080), ILYTIL (SEQ ID NO: 1081), IMYTLV (SEQ ID NO: 1082), INYCSV (SEQ ID NO: 1083), INYKDI (SEQ ID NO: 1084), INYTTV (SEQ ID NO: 1085), INYVLL (SEQ ID NO: 1086), IPYDVL (SEQ ID NO: 1087), IPYLLV (SEQ ID NO: 1088), IPYRTV (SEQ ID NO: 1089), IPYSQL (SEQ ID NO: 1090), IPYSRI (SEQ ID NO: 1091), IPYTQI (SEQ ID NO: 1092), IQYAPL (SEQ ID NO: 1093), IQYASL (SEQ ID NO: 1094), IQYERL (SEQ ID NO: 1095), IQYGII (SEQ ID NO: 1096), IQYGNV (SEQ ID NO: 1097), IQYGRV (SEQ ID NO: 1098), IQYNW (SEQ ID NO: 1099), IQYRSI (SEQ ID NO: 1100), IQYTEL (SEQ ID NO: 2047), IQYWGI (SEQ ID NO: 1102), IRYANL (SEQ ID NO: 1103), IRYLDL (SEQ ID NO: 1104), IRYPLL (SEQ ID NO: 1105), IRYRLL (SEQ ID NO: 1106), IRYRTI (SEQ ID NO: 1107), ISYASL (SEQ ID NO: 1108), ISYCGV (SEQ ID NO: 1109), ISYEPI (SEQ ID NO: 1110), ISYFQI (SEQ ID NO: 1111), ISYGLI (SEQ ID NO: 1112), ISYKKL (SEQ ID NO: 1113), ISYLPL (SEQ ID NO: 1114), ISYPML (SEQ ID NO: 1115), ISYTTL (SEQ ID NO: 1116), ITYAAV (SEQ ID NO: 1117), ITYADL (SEQ ID NO: 1118), ITYAEL (SEQ ID NO: 1119), ITYAEV (SEQ ID NO: 1120), ITYASV (SEQ ID NO: 1121), ITYDLI (SEQ ID NO: 1122), ITYENV (SEQ ID NO: 1123), ITYQLL (SEQ ID NO: 1124), ITYSLL (SEQ ID NO: 1125), IVYAEL (SEQ ID NO: 1126), IVYALV (SEQ ID NO: 1127), IVYASL (SEQ ID NO: 1128), IVYEIL (SEQ ID NO: 1129), IVYFIL (SEQ ID NO: 1130), IVYHML (SEQ ID NO: 1131), IVYLCI (SEQ ID NO: 1132), IVYRLL (SEQ ID NO: 1133), IVYSAL (SEQ ID NO: 1134), IVYSWV (SEQ ID NO: 1135), IVYTEL (SEQ ID NO: 1136), IVYYIL (SEQ ID NO: 1137), IWYENL (SEQ ID NO: 1138), IWYFVV (SEQ ID NO: 1139), IWYNIL (SEQ ID NO: 1140), IYYLGV (SEQ ID NO: 1141), LAYALL (SEQ ID NO: 1142), LAYARI (SEQ ID NO: 1143), LAYDSV (SEQ ID NO: 1144), LAYFGV (SEQ ID NO: 1145), LAYHRL (SEQ ID NO: 1146), LAYKDL (SEQ ID NO: 1147), LAYKRI (SEQ ID NO: 1148), LAYPPL (SEQ ID NO: 1149), LAYQTL (SEQ ID NO: 1150), LAYREV (SEQ ID NO: 1151), LAYRII (SEQ ID NO: 1152), LAYRLL (SEQ ID NO: 1153), LAYSQL (SEQ ID NO: 1154), LAYSSV (SEQ ID NO: 1155), LAYTLL (SEQ ID NO: 1156), LAYWGI (SEQ ID NO: 1157), LAYYTV (SEQ ID NO: 1158), LCYADL (SEQ ID NO: 1159), LCYAIL (SEQ ID NO: 1160), LCYFHL (SEQ ID NO: 1161), LCYHPI (SEQ ID NO: 1162), LCYKEI (SEQ ID NO: 1163), LCYKFL (SEQ ID NO: 1164), LCYMII (SEQ ID NO: 1165), LCYRKI (SEQ ID NO: 1166), LCYRVL (SEQ ID NO: 1167), LCYSTV (SEQ ID NO: 1168), LCYTLV (SEQ ID NO: 1169), LDYASI (SEQ ID NO: 1170), LDYCEL (SEQ ID NO: 1171), LDYDKI (SEQ ID NO: 1172), LDYDKL (SEQ ID NO: 1173), LDYDYL (SEQ ID NO: 1174), LDYDYV (SEQ ID NO: 1175), LDYEFL (SEQ ID NO: 1176), LDYINV (SEQ ID NO: 1177), LDYNNL (SEQ ID NO: 1178), LDYPHV (SEQ ID NO: 1179), LDYSPV (SEQ ID NO: 1180), LDYVEI (SEQ ID NO: 1181), LDYWGI (SEQ ID NO: 1182), LEYAPV (SEQ ID NO: 1183), LEYIPL (SEQ ID NO: 1184), LEYKTI (SEQ ID NO: 1185), LEYLCL (SEQ ID NO: 1186), LEYLKL (SEQ ID NO: 1187), LEYLQI (SEQ ID NO: 1188), LEYLQL (SEQ ID NO: 1189), LEYQRL (SEQ ID NO: 1190), LEYVDL (SEQ ID NO: 1191), LEYVSV (SEQ ID NO: 1192), LEYYQI (SEQ ID NO: 1193), LFYAQL (SEQ ID NO: 1194), LFYCSV (SEQ ID NO: 1195), LFYERV (SEQ ID NO: 1196), LFYGFL (SEQ ID NO: 1197), LFYKYV (SEQ ID NO: 1198), LFYLLL (SEQ ID NO: 1199), LFYNKV (SEQ ID NO: 1200), LFYRHL (SEQ ID NO: 1201), LFYTLL (SEQ ID NO: 1202), LFYWDV (SEQ ID NO: 1203), LFYWKL (SEQ ID NO: 1204), LGYGNV (SEQ ID NO: 1205), LGYKEL (SEQ ID NO: 1206), LGYLQL (SEQ ID NO: 1207), LGYPLI (SEQ ID NO: 1208), LGYPWV (SEQ ID NO: 1209), LGYSAL (SEQ ID NO: 1210), LGYSDL (SEQ ID NO: 1211), LGYVTL (SEQ ID NO: 1212), LHYAKI (SEQ ID NO: 1213), LHYALV (SEQ ID NO: 1214), LHYANL (SEQ ID NO: 1215), LHYARL (SEQ ID NO: 1216), LHYASI (SEQ ID NO: 1217), LHYASL (SEQ ID NO: 1218), LHYASV (SEQ ID NO: 1219), LHYATI (SEQ ID NO: 1220), LHYATL (SEQ ID NO: 1221), LHYAVL (SEQ ID NO: 1222), LHYDW (SEQ ID NO: 1223), LHYEGL (SEQ ID NO: 1224), LHYETI (SEQ ID NO: 1225), LHYFEI (SEQ ID NO: 1226), LHYFW (SEQ ID NO: 1227), LHYGAI (SEQ ID NO: 1228), LHYILI (SEQ ID NO: 1229), LHYINL (SEQ ID NO: 1230), LHYKRI (SEQ ID NO: 1231), LHYLDL (SEQ ID NO: 1232), LHYLNI (SEQ ID NO: 1233), LHYLTI (SEQ ID NO: 1234), LHYLVI (SEQ ID NO: 1235), LHYMAI (SEQ ID NO: 1236), LHYMII (SEQ ID NO: 1237), LHYMNI (SEQ ID NO: 1238), LHYMTI (SEQ ID NO: 1239), LHYMTL (SEQ ID NO: 1240), LHYMTV (SEQ ID NO: 1241), LHYMVI (SEQ ID NO: 1242), LHYNML (SEQ ID NO: 1243), LHYPAL (SEQ ID NO: 1244), LHYPDL (SEQ ID NO: 1245), LHYPII (SEQ ID NO: 1246), LHYPIL (SEQ ID NO: 1247), LHYPLL (SEQ ID NO: 1248), LHYPML (SEQ ID NO: 1249), LHYPNV (SEQ ID NO: 1250), LHYPSI (SEQ ID NO: 1251), LHYPTI (SEQ ID NO: 1252), LHYPTL (SEQ ID NO: 1253), LHYPTV (SEQ ID NO: 1254), LHYPVI (SEQ ID NO: 1255), LHYPVL (SEQ ID NO: 1256), LHYRII (SEQ ID NO: 1257), LHYRTI (SEQ ID NO: 1258), LHYSII (SEQ ID NO: 1259), LHYSSI (SEQ ID NO: 1260), LHYSTI (SEQ ID NO: 1261), LHYSTL (SEQ ID NO: 1262), LHYSVI (SEQ ID NO: 1263), LHYTAI (SEQ ID NO: 1264), LHYTAL (SEQ ID NO: 1265), LHYTII (SEQ ID NO: 1266), LHYTKV (SEQ ID NO: 1267), LHYTLI (SEQ ID NO: 1268), LHYTSI (SEQ ID NO: 1269), LHYTTI (SEQ ID NO: 1270), LHYTTV (SEQ ID NO: 1271), LHYTVI (SEQ ID NO: 1272), LHYTVL (SEQ ID NO: 1273), LHYTW (SEQ ID NO: 1274), LHYVSI (SEQ ID NO: 1275), LHYVTI (SEQ ID NO: 1276), LHYWI (SEQ ID NO: 1277), LIYEKL (SEQ ID NO: 1278), LIYENV (SEQ ID NO: 1279), LIYKDL (SEQ ID NO: 1280), LIYNSL (SEQ ID NO: 1281), LIYSGL (SEQ ID NO: 1282), LIYTLL (SEQ ID NO: 1283), LIYTVL (SEQ ID NO: 1284), LIYWEI (SEQ ID NO: 1285), LKYCEL (SEQ ID NO: 1286), LKYDKL (SEQ ID NO: 1287), LKYESL (SEQ ID NO: 1288), LKYFTI (SEQ ID NO: 1289), LKYHTV (SEQ ID NO: 1290), LKYILL (SEQ ID NO: 1291), LKYIPI (SEQ ID NO: 1292), LKYKHV (SEQ ID NO: 1293), LKYLYL (SEQ ID NO: 1294), LKYMEV (SEQ ID NO: 1295), LKYMTL (SEQ ID NO: 1296), LKYPAI (SEQ ID NO: 1297), LKYPDV (SEQ ID NO: 1298), LKYPEL (SEQ ID NO: 1299), LKYQPI (SEQ ID NO: 1300), LKYRGL (SEQ ID NO: 1301), LKYRLL (SEQ ID NO: 1302), LLYADL (SEQ ID NO: 1303), LLYAPL (SEQ ID NO: 1304), LLYAVV (SEQ ID NO: 1305), LLYCAI (SEQ ID NO: 1306), LLYEHV (SEQ ID NO: 1307), LLYELL (SEQ ID NO: 1308), LLYEQL (SEQ ID NO: 1309), LLYGQI (SEQ ID NO: 1310), LLYIRL (SEQ ID NO: 1311), LLYKAL (SEQ ID NO: 1312), LLYKFL (SEQ ID NO: 1313), LLYKLL (SEQ ID NO: 1314), LLYKTV (SEQ ID NO: 1315), LLYMVV (SEQ ID NO: 1316), LLYNAI (SEQ ID NO: 1317), LLYNIV (SEQ ID NO: 1318), 1319), LLYPAI (SEQ ID NO: 1320), LLYPLI (SEQ ID NO: 1321), LLYPNI (SEQ ID NO: 1322), LLYPSL (SEQ ID NO: 1323), LLYPTI (SEQ ID NO: 1324), LLYPVI (SEQ ID NO: 1325), LLYPVV (SEQ ID NO: 1326), LLYQIL (SEQ ID NO: 1327), LLYQNI (SEQ ID NO: 1328), LLYRLL (SEQ ID NO: 1329), LLYRVI (SEQ ID NO: 1330), LLYSII (SEQ ID NO: 1331), LLYSLI (SEQ ID NO: 1332), LLYSPV (SEQ ID NO: 1333), LLYSRL (SEQ ID NO: 1334), LLYSTI (SEQ ID NO: 1335), LLYSVI (SEQ ID NO: 1336), LLYSW (SEQ ID NO: 1337), LLYTTI (SEQ ID NO: 1338), LLYTVI (SEQ ID NO: 1339), LLYTVV (SEQ ID NO: 1340), LLYVII (SEQ ID NO: 1341), LLYVIL (SEQ ID NO: 1342), LLYVTI (SEQ ID NO: 1343), LLYWGI (SEQ ID NO: 1344), LLYYLL (SEQ ID NO: 1345), LLYYVI (SEQ ID NO: 1346), LMYDNV (SEQ ID NO: 1347), LMYMW (SEQ ID NO: 1348), LMYQEL (SEQ ID NO: 1349), LMYRGI (SEQ ID NO: 1350), LNYACL (SEQ ID NO: 1351), LNYATI (SEQ ID NO: 1352), LNYEVI (SEQ ID NO: 1353), LNYGDL (SEQ ID NO: 1354), LNYHKL (SEQ ID NO: 1355), LNYMVL (SEQ ID NO: 1356), LNYNIV (SEQ ID NO: 1357), LNYPVI (SEQ ID NO: 1358), LNYQMI (SEQ ID NO: 1359), LNYSGV (SEQ ID NO: 1360), LNYSVI (SEQ ID NO: 1361), LNYTIL (SEQ ID NO: 1362), LNYTTI (SEQ ID NO: 1363), LNYVPI (SEQ ID NO: 1364), LPYADL (SEQ ID NO: 1365), LPYALL (SEQ ID NO: 1366), LPYFNI (SEQ ID NO: 1367), LPYFNV (SEQ ID NO: 1368), LPYHDL (SEQ ID NO: 1369), LPYKLI (SEQ ID NO: 1370), LPYKTL (SEQ ID NO: 1371), LPYLGV (SEQ ID NO: 1372), LPYLKV (SEQ ID NO: 1373), LPYPAL (SEQ ID NO: 1374), LPYQW (SEQ ID NO: 1375), LPYRTV (SEQ ID NO: 1376), LPYVEI (SEQ ID NO: 1377), LPYYDL (SEQ ID NO: 1378), LQYASL (SEQ ID NO: 1379), LQYERI (SEQ ID NO: 1380), LQYFAV (SEQ ID NO: 1381), LQYFSI (SEQ ID NO: 1382), LQYHNI (SEQ ID NO: 1383), LQYIGL (SEQ ID NO: 1384), LQYIKI (SEQ ID NO: 1385), LQYLSL (SEQ ID NO: 1386), LQYMIV (SEQ ID NO: 1387), LQYPAI (SEQ ID NO: 1388), LQYPLL (SEQ ID NO: 1389), LQYPLV (SEQ ID NO: 1390), LQYPSI (SEQ ID NO: 1391), LQYPTL (SEQ ID NO: 1392), LQYPVL (SEQ ID NO: 1393), LQYRAV (SEQ ID NO: 1394), LQYSAI (SEQ ID NO: 1395), LQYSSI (SEQ ID NO: 1396), LQYSVI (SEQ ID NO: 1397), LQYTIL (SEQ ID NO: 1398), LQYTLI (SEQ ID NO: 1399), LQYTMI (SEQ ID NO: 1400), LQYYQV (SEQ ID NO: 1401), LRYAAV (SEQ ID NO: 1402), LRYAGL (SEQ ID NO: 1403), LRYAPL (SEQ ID NO: 1404), LRYASI (SEQ ID NO: 1405), LRYATI (SEQ ID NO: 1406), LRYATV (SEQ ID NO: 1407), LRYAVL (SEQ ID NO: 1408), LRYCGI (SEQ ID NO: 1409), LRYELL (SEQ ID NO: 1410), LRYETL (SEQ ID NO: 1411), LRYGAL (SEQ ID NO: 1412), LRYGPI (SEQ ID NO: 1413), LRYGTL (SEQ ID NO: 1414), LRYHHI (SEQ ID NO: 1415), LRYHSI (SEQ ID NO: 1416), LRYHVL (SEQ ID NO: 1417), LRYIAI (SEQ ID NO: 1418), LRYIFV (SEQ ID NO: 1419), LRYITV (SEQ ID NO: 1420), LRYKEV (SEQ ID NO: 1421), LRYKKL (SEQ ID NO: 1422), LRYKMV (SEQ ID NO: 1423), LRYKSL (SEQ ID NO: 1424), LRYKVI (SEQ ID NO: 1425), LRYLAI (SEQ ID NO: 1426), LRYLDL (SEQ ID NO: 1427), LRYLTI (SEQ ID NO: 1428), LRYLTV (SEQ ID NO: 1429), LRYMSI (SEQ ID NO: 1430), LRYMVI (SEQ ID NO: 1431), LRYNCI (SEQ ID NO: 1432), LRYNGL (SEQ ID NO: 1433), LRYNII (SEQ ID NO: 1434), LRYNIL (SEQ ID NO: 1435), LRYNKI (SEQ ID NO: 1436), LRYNSL (SEQ ID NO: 1437), LRYNVI (SEQ ID NO: 1438), LRYNVL (SEQ ID NO: 1439), LRYPFL (SEQ ID NO: 1440), LRYPII (SEQ ID NO: 1441), LRYPIL (SEQ ID NO: 1442), LRYPLL (SEQ ID NO: 1443), LRYPNI (SEQ ID NO: 1444), LRYPSI (SEQ ID NO: 1445), LRYPTI (SEQ ID NO: 1446), LRYPTL (SEQ ID NO: 1447), LRYPVI (SEQ ID NO: 1448), LRYPVL (SEQ ID NO: 1449), LRYQKL (SEQ ID NO: 1450), LRYQMI (SEQ ID NO: 1451), LRYQNL (SEQ ID NO: 1452), LRYRLI (SEQ ID NO: 1453), LRYRVI (SEQ ID NO: 1454), LRYSAI (SEQ ID NO: 1455), LRYSDL (SEQ ID NO: 1456), LRYSII (SEQ ID NO: 1457), LRYSMI (SEQ ID NO: 1458), LRYSSI (SEQ ID NO: 1459), LRYSTI (SEQ ID NO: 1460), LRYSTL (SEQ ID NO: 1461), LRYSVI (SEQ ID NO: 1462), LRYSVL (SEQ ID NO: 1463), LRYSW (SEQ ID NO: 1464), LRYTAI (SEQ ID NO: 1465), LRYTIL (SEQ ID NO: 1466), LRYTLI (SEQ ID NO: 1467), LRYTMI (SEQ ID NO: 1468), LRYTNL (SEQ ID NO: 1469), LRYTPV (SEQ ID NO: 1470), LRYTSI (SEQ ID NO: 1471), LRYTSV (SEQ ID NO: 1472), LRYTTI (SEQ ID NO: 1473), LRYTTV (SEQ ID NO: 1474), LRYTVI (SEQ ID NO: 1475), LRYVEV (SEQ ID NO: 1476), LRYVTI (SEQ ID NO: 1477), LRYVTV (SEQ ID NO: 1478), LSYDSL (SEQ ID NO: 1479), LSYEDV (SEQ ID NO: 1480), LSYFGV (SEQ ID NO: 1481), LSYILI (SEQ ID NO: 1482), LSYISV (SEQ ID NO: 1483), LSYKQV (SEQ ID NO: 1484), LSYKRL (SEQ ID NO: 1485), LSYLDV (SEQ ID NO: 1486), LSYMDL (SEQ ID NO: 1487), LSYNAL (SEQ ID NO: 1488), LSYNDL (SEQ ID NO: 1489), LSYNKL (SEQ ID NO: 1490), LSYNQL (SEQ ID NO: 1491), LSYPVL (SEQ ID NO: 1492), LSYQEV (SEQ ID NO: 1493), LSYQPV (SEQ ID NO: 1494), LSYQTI (SEQ ID NO: 1495), LSYRSL (SEQ ID NO: 1496), LSYRSV (SEQ ID NO: 1497), LSYSII (SEQ ID NO: 1498), LSYSSL (SEQ ID NO: 1499), LSYSTL (SEQ ID NO: 1500), LSYTKV (SEQ ID NO: 1501), LSYTSI (SEQ ID NO: 1502), LSYTTI (SEQ ID NO: 1503), LSYVLI (SEQ ID NO: 1504), LTYADL (SEQ ID NO: 1505), LTYAEL (SEQ ID NO: 1506), LTYAQV (SEQ ID NO: 1507), LTYARL (SEQ ID NO: 1508), LTYCDL (SEQ ID NO: 1509), LTYCGL (SEQ ID NO: 1510), LTYCVL (SEQ ID NO: 1511), LTYEEL (SEQ ID NO: 1512), LTYEFL (SEQ ID NO: 1513), LTYGEV (SEQ ID NO: 1514), LTYGRL (SEQ ID NO: 1515), LTYKAL (SEQ ID NO: 1516), LTYLRL (SEQ ID NO: 1517), LTYMTL (SEQ ID NO: 1518), LTYNTL (SEQ ID NO: 1519), LTYPGI (SEQ ID NO: 1520), LTYQSV (SEQ ID NO: 1521), LTYSSV (SEQ ID NO: 1522), LTYTTV (SEQ ID NO: 1523), LVYDAI (SEQ ID NO: 1524), LVYDKL (SEQ ID NO: 1525), LVYDLV (SEQ ID NO: 1526), LVYENL (SEQ ID NO: 1527), LVYGQL (SEQ ID NO: 1528), LVYHKL (SEQ ID NO: 1529), LVYQEV (SEQ ID NO: 1530), LVYRKV (SEQ ID NO: 1531), LVYRNL (SEQ ID NO: 1532), LVYSEI (SEQ ID NO: 1533), LVYTNV (SEQ ID NO: 1534), LVYWEI (SEQ ID NO: 1535), LVYWKL (SEQ ID NO: 1536), LVYWRL (SEQ ID NO: 1537), LWYEGL (SEQ ID NO: 1538), LWYKYI (SEQ ID NO: 1539), LWYNHI (SEQ ID NO: 1540), LWYTMI (SEQ ID NO: 1541), LYYCQL (SEQ ID NO: 1542), LYYGDL (SEQ ID NO: 1543), LYYKKV (SEQ ID NO: 1544), LYYLLI (SEQ ID NO: 1545), LYYPKV (SEQ ID NO: 1546), LYYRRV (SEQ ID NO: 1547), LYYSTI (SEQ ID NO: 1548), LYYVRI (SEQ ID NO: 1549), LYYWI (SEQ ID NO: 1550), SAYATL (SEQ ID NO: 1551), SAYCPL (SEQ ID NO: 1552), SAYPAL (SEQ ID NO: 1553), SAYQAL (SEQ ID NO: 1554), SAYQTI (SEQ ID NO: 1555), SAYRSV (SEQ ID NO: 1556), SAYTAL (SEQ ID NO: 1557), SAYTPL (SEQ ID NO: 1558), SAYVVL (SEQ ID NO: 1559), SCYAAV (SEQ ID NO: 1560), SCYCII (SEQ ID NO: 1561), SCYCLL (SEQ ID NO: 1562), SCYDFL (SEQ ID NO: 1563), SCYEEL (SEQ ID NO: 1564), SCYEKI (SEQ ID NO: 1565), SCYHIL (SEQ ID NO: 1566), SCYPYI (SEQ ID NO: 1567), SCYRIL (SEQ ID NO: 1568), SCYRTL (SEQ ID NO: 1569), SDYCNL (SEQ ID NO: 1570), SDYEDL (SEQ ID NO: 1571), SDYENV (SEQ ID NO: 1572), SDYESV (SEQ ID NO: 1573), SDYFIV (SEQ ID NO: 1574), SDYHTL (SEQ ID NO: 1575), SDYLAI (SEQ ID NO: 1576), SDYLDI (SEQ ID NO: 1577), SDYLEL (SEQ ID NO: 1578), SDYQDL (SEQ ID NO: 1579), SDYQRL (SEQ ID NO: 1580), SDYSVI (SEQ ID NO: 1581), SDYTHL (SEQ ID NO: 1582), SEYASV (SEQ ID NO: 1583), SEYEEL (SEQ ID NO: 1584), SEYFEL (SEQ ID NO: 1585), SEYGEL (SEQ ID NO: 1586), SEYITL (SEQ ID NO: 1587), SEYKAL (SEQ ID NO: 1588), SEYKEL (SEQ ID NO: 1589), SEYKGI (SEQ ID NO: 1590), SEYLAI (SEQ ID NO: 1591), SEYLEI (SEQ ID NO: 1592), SEYMVI (SEQ ID NO: 1593), SEYQSI (SEQ ID NO: 1594), SEYRPI (SEQ ID NO: 1595), SEYSEI (SEQ ID NO: 1596), SEYSSI (SEQ ID NO: 1597), SEYTPI (SEQ ID NO: 1598), SEYTYV (SEQ ID NO: 1599), SFYAAL (SEQ ID NO: 1600), SFYDSL (SEQ ID NO: 1601), SFYKGL (SEQ ID NO: 1602), SFYLYV (SEQ ID NO: 1603), SFYNAV (SEQ ID NO: 1604), SFYPSV (SEQ ID NO: 1605), SFYQQI (SEQ ID NO: 1606), SFYQQL (SEQ ID NO: 1607), SFYSAL (SEQ ID NO: 1608), SFYSDI (SEQ ID NO: 1609), SFYSKL (SEQ ID NO: 1610), SFYSRV (SEQ ID NO: 1611), SFYWNV (SEQ ID NO: 1612), SFYYLI (SEQ ID NO: 1613), SGYAQL (SEQ ID NO: 1614), SGYATL (SEQ ID NO: 1615), SGYEKL (SEQ ID NO: 1616), SGYQLV (SEQ ID NO: 1617), SGYQRI (SEQ ID NO: 1618), SGYRRL (SEQ ID NO: 1619), SGYSHL (SEQ ID NO: 1620), SGYSQL (SEQ ID NO: 1621), SGYTLI (SEQ ID NO: 1622), SGYTRI (SEQ ID NO: 1623), SGYYRV (SEQ ID NO: 1624), SHYADV (SEQ ID NO: 1625), SHYFPL (SEQ ID NO: 1626), SHYIDI (SEQ ID NO: 1627), SHYKRL (SEQ ID NO: 1628), SHYQVV (SEQ ID NO: 1629), SIYAPL (SEQ ID NO: 1630), SIYATL (SEQ ID NO: 1631), SIYEEL (SEQ ID NO: 1632), SIYEEV (SEQ ID NO: 1633), SIYELL (SEQ ID NO: 1634), SIYEVL (SEQ ID NO: 1635), SIYGDL (SEQ ID NO: 1636), SIYKKL (SEQ ID NO: 1637), SIYLNI (SEQ ID NO: 1638), SIYLVI (SEQ ID NO: 1639), SIYRYI (SEQ ID NO: 1640), SIYSWI (SEQ ID NO: 1641), SKYKEI (SEQ ID NO: 1642), SKYKIL (SEQ ID NO: 1643), SKYKSL (SEQ ID NO: 1644), SKYLAV (SEQ ID NO: 1645), SKYLGV (SEQ ID NO: 1646), SKYNIL (SEQ ID NO: 1647), SKYQAV (SEQ ID NO: 1648), SKYSDI (SEQ ID NO: 1649), SKYSSL (SEQ ID NO: 1650), SKYVGL (SEQ ID NO: 1651), SKYVSL (SEQ ID NO: 1652), SLYANI (SEQ ID NO: 1653), SLYAQV (SEQ ID NO: 1654), SLYAYI (SEQ ID NO: 1655), SLYDDL (SEQ ID NO: 1656), SLYDFL (SEQ ID NO: 1657), SLYDNL (SEQ ID NO: 1658), SLYDSI (SEQ ID NO: 1659), SLYDYL (SEQ ID NO: 1660), SLYEGL (SEQ ID NO: 1661), SLYEHI (SEQ ID NO: 1662), SLYELL (SEQ ID NO: 1663), SLYHCL (SEQ ID NO: 1664), SLYHKL (SEQ ID NO: 1665), SLYIGI (SEQ ID NO: 1666), SLYKKL (SEQ ID NO: 1667), SLYKNL (SEQ ID NO: 1668), SLYLAI (SEQ ID NO: 1669), SLYLGI (SEQ ID NO: 1670), SLYNAL (SEQ ID NO: 1671), SLYNLL (SEQ ID NO: 1672), SLYRNI (SEQ ID NO: 1673), SLYSDV (SEQ ID NO: 1674), SLYTCV (SEQ ID NO: 1675), SLYTTL (SEQ ID NO: 1676), SLYVAI (SEQ ID NO: 1677), SLYVDV (SEQ ID NO: 1678), SLYVSI (SEQ ID NO: 1679), SLYYAL (SEQ ID NO: 1680), SLYYNI (SEQ ID NO: 1681), SLYYPI (SEQ ID NO: 1682), SMYDGL (SEQ ID NO: 1683), SMYEDI (SEQ ID NO: 1684), SMYNEI (SEQ ID NO: 1685), SMYQSV (SEQ ID NO: 1686), SMYTWL (SEQ ID NO: 1687), SMYVSI (SEQ ID NO: 1688), SNYENL (SEQ ID NO: 1689), SNYGSL (SEQ ID NO: 1690), SNYGTI (SEQ ID NO: 1691), SNYLVL (SEQ ID NO: 1692), SNYQEI (SEQ ID NO: 1693), SNYRLL (SEQ ID NO: 1694), SNYRTL (SEQ ID NO: 1695), SNYSDI (SEQ ID NO: 1696), SNYSLL (SEQ ID NO: 1697), SPYAEI (SEQ ID NO: 1698), SPYATL (SEQ ID NO: 1699), SPYEKV (SEQ ID NO: 1700), SPYGDI (SEQ ID NO: 1701), SPYGGL (SEQ ID NO: 1702), SPYNTL (SEQ ID NO: 1703), SPYPGI (SEQ ID NO: 1704), SPYPGV (SEQ ID NO: 1705), SPYQEL (SEQ ID NO: 1706), SPYRSV (SEQ ID NO: 1707), SPYSRL (SEQ ID NO: 1708), SPYTDV (SEQ ID NO: 1709), SPYTSV (SEQ ID NO: 1710), SPYVVI (SEQ ID NO: 1711), SQYCVL (SEQ ID NO: 1712), SQYEAL (SEQ ID NO: 1713), SQYKRL (SEQ ID NO: 1714), SQYLAL (SEQ ID NO: 1715), SQYLRL (SEQ ID NO: 1716), SQYMHV (SEQ ID NO: 1717), SQYSAV (SEQ ID NO: 1718), SQYTSI (SEQ ID NO: 1719), SQYWRL (SEQ ID NO: 1720), SRYAEL (SEQ ID NO: 1721), SRYATL (SEQ ID NO: 1722), SRYESL (SEQ ID NO: 1723), SRYGLL (SEQ ID NO: 1724), SRYLSL (SEQ ID NO: 1725), SRYMEL (SEQ ID NO: 1726), SRYMRI (SEQ ID NO: 1727), SRYPPV (SEQ ID NO: 1728), SRYQAL (SEQ ID NO: 1729), SRYQQL (SEQ ID NO: 1730), SRYRFI (SEQ ID NO: 1731), SRYRFV (SEQ ID NO: 1732), SRYSAL (SEQ ID NO: 1733), SRYSDL (SEQ ID NO: 1734), SRYTGL (SEQ ID NO: 1735), SRYVRL (SEQ ID NO: 1736), SSYDEL (SEQ ID NO: 1737), SSYEAL (SEQ ID NO: 1738), SSYEIV (SEQ ID NO: 1739), SSYEPL (SEQ ID NO: 1740), SSYGRL (SEQ ID NO: 1741), SSYGSI (SEQ ID NO: 1742), SSYGSL (SEQ ID NO: 1743), SSYHII (SEQ ID NO: 1744), SSYHIL (SEQ ID NO: 1745), SSYHKL (SEQ ID NO: 1746), SSYHNI (SEQ ID NO: 1747), SSYIKV (SEQ ID NO: 1748), SSYNSV (SEQ ID NO: 1749), SSYQEI (SEQ ID NO: 1750), SSYRKV (SEQ ID NO: 1751), SSYRRV (SEQ ID NO: 1752), SSYSDI (SEQ ID NO: 1753), SSYTPL (SEQ ID NO: 1754), SSYTRL (SEQ ID NO: 1755), SSYTSV (SEQ ID NO: 1756), SSYTTI (SEQ ID NO: 1757), SSYVKL (SEQ ID NO: 1758), STYAEV (SEQ ID NO: 1759), STYAGI (SEQ ID NO: 1760), STYAHL (SEQ ID NO: 1761), STYALV (SEQ ID NO: 1762), STYAPI (SEQ ID NO: 1763), STYDHV (SEQ ID NO: 1764), STYDKV (SEQ ID NO: 1765), STYDQV (SEQ ID NO: 1766), STYDRI (SEQ ID NO: 1767), STYEEL (SEQ ID NO: 1768), STYEYL (SEQ ID NO: 1769), STYILV (SEQ ID NO: 1770), STYLPL (SEQ ID NO: 1771), STYMAV (SEQ ID NO: 1772), STYQTL (SEQ ID NO: 1773), STYRKL (SEQ ID NO: 1774), STYSQL (SEQ ID NO: 1775), STYTSI (SEQ ID NO: 1776), STYYQV (SEQ ID NO: 1777), SVYATL (SEQ ID NO: 1778), SVYCFL (SEQ ID NO: 1779), SVYCNL (SEQ ID NO: 1780), SVYDSV (SEQ ID NO: 1781), SVYDTI (SEQ ID NO: 1782), SVYEKV (SEQ ID NO: 1783), SVYEML (SEQ ID NO: 1784), SVYGSV (SEQ ID NO: 1785), SVYPII (SEQ ID NO: 1786), SVYQPI (SEQ ID NO: 1787), SVYRKV (SEQ ID NO: 1788), SVYSHL (SEQ ID NO: 1789), SVYSRV (SEQ ID NO: 1790), SVYTAL (SEQ ID NO: 1791), SVYTEL (SEQ ID NO: 1792), SVYWKV (SEQ ID NO: 1793), SWYDSI (SEQ ID NO: 1794), SWYFTV (SEQ ID NO: 1795), SYYKAI (SEQ ID NO: 1796), SYYLKL (SEQ ID NO: 1797), SYYSFV (SEQ ID NO: 1798), SYYVTI (SEQ ID NO: 1799), VAYADL (SEQ ID NO: 1800), VAYARI (SEQ ID NO: 1801), VAYARV (SEQ ID NO: 1802), VAYDQL (SEQ ID NO: 1803), VAYGHV (SEQ ID NO: 1804), VAYKQV (SEQ ID NO: 1805), VAYKRL (SEQ ID NO: 1806), VAYNLL (SEQ ID NO: 1807), VAYQRV (SEQ ID NO: 1808), VAYSGV (SEQ ID NO: 1809), VAYSQV (SEQ ID NO: 1810), VCY- CIV (SEQ ID NO: 1811), VCYGLV (SEQ ID NO: 1812), VCYGRL (SEQ ID NO: 1813), VCYIW (SEQ ID NO: 1814), VCYLLV (SEQ ID NO: 1815), VDYDCI (SEQ ID NO: 1816), VDYDFL (SEQ ID NO: 1817), VDYFTI (SEQ ID NO: 1818), VDYFVL (SEQ ID NO: 1819), VDYGEL (SEQ ID NO: 1820), VDYILV (SEQ ID NO: 1821), VDYIQV (SEQ ID NO: 1822), VDYKNI (SEQ ID NO: 1823), VDYMSI (SEQ ID NO: 1824), VDYNLV (SEQ ID NO: 1825), VDYPDV (SEQ ID NO: 1826), VDYSDL (SEQ ID NO: 1827), VDYSSV (SEQ ID NO: 1828), VDYTTL (SEQ ID NO: 1829), VDYVDV (SEQ ID NO: 1830), VDYVGV (SEQ ID NO: 1831), VDYVIL (SEQ ID NO: 1832), VDYVQV (SEQ ID NO: 1833), VEYAPL (SEQ ID NO: 1834), VEYDPL (SEQ ID NO: 1835), VEYGTI (SEQ ID NO: 1836), VEYHRL (SEQ ID NO: 1837), VEYLEV (SEQ ID NO: 1838), VEYQLL (SEQ ID NO: 1839), VEYRPL (SEQ ID NO: 1840), VEYSSI (SEQ ID NO: 1841), VEYSTV (SEQ ID NO: 1842), VFYAEI (SEQ ID NO: 1843), VFYLAV (SEQ ID NO: 1844), VFYRQV (SEQ ID NO: 1845), VFYVGV (SEQ ID NO: 1846), VFYYVI (SEQ ID NO: 1847), VFYYVL (SEQ ID NO: 1848), VGYETI (SEQ ID NO: 1849), VHYALL (SEQ ID NO: 1850), VHYARL (SEQ ID NO: 1851), VHYETL (SEQ ID NO: 1852), VHYGGV (SEQ ID NO: 1853), VHYHSL (SEQ ID NO: 1854), VHYIPV (SEQ ID NO: 1855), VHYKEI (SEQ ID NO: 1856), VHYLQV (SEQ ID NO: 1857), VHYNSL (SEQ ID NO: 1858), VHYQSV (SEQ ID NO: 1859), VHYRSL (SEQ ID NO: 1860), VIYAQL (SEQ ID NO: 1861), VIYDRL (SEQ ID NO: 1862), VIYENV (SEQ ID NO: 1863), VIYEPL (SEQ ID NO: 1864), VIYERL (SEQ ID NO: 1865), VIYIDV (SEQ ID NO: 1866), VIYKKI (SEQ ID NO: 1867), VIYKRI (SEQ ID NO: 1868), VIYPFL (SEQ ID NO: 1869), VIYPNI (SEQ ID NO: 1870), VIYSDL (SEQ ID NO: 1871), VIYSML (SEQ ID NO: 1872), VIYSSV (SEQ ID NO: 1873), VIYSWI (SEQ ID NO: 1874), VKYADI (SEQ ID NO: 1875), VKYARL (SEQ ID NO: 1876), VKYATL (SEQ ID NO: 1877), VKYEGL (SEQ ID NO: 1878), VKYGDL (SEQ ID NO: 1879), VKYGSV (SEQ ID NO: 1880), VKYLLV (SEQ ID NO: 1881), VKYNPV (SEQ ID NO: 1882), VKYPPI (SEQ ID NO: 1883), VKYQRL (SEQ ID NO: 1884), VKYQVI (SEQ ID NO: 1885), VKYSEV (SEQ ID NO: 1886), VKYSNV (SEQ ID NO: 1887), VKYSRL (SEQ ID NO: 1888), VKYSTL (SEQ ID NO: 1889), VKYVDL (SEQ ID NO: 1890), VLYADI (SEQ ID NO: 1891), VLYAML (SEQ ID NO: 1892), VLYASV (SEQ ID NO: 1893), VLYCLL (SEQ ID NO: 1894), VLYCLV (SEQ ID NO: 1895), VLYCVL (SEQ ID NO: 1896), VLYDCL (SEQ ID NO: 1897), VLYFHI (SEQ ID NO: 1898), VLYFTV (SEQ ID NO: 1899), VLYGDL (SEQ ID NO: 1900), VLYGQL (SEQ ID NO: 1901), VLYPMV (SEQ ID NO: 1902), VLYPRL (SEQ ID NO: 1903), VLYPRV (SEQ ID NO: 1904), VLYSEL (SEQ ID NO: 1905), VLYSRV (SEQ ID NO: 1906), VLYTAV (SEQ ID NO: 1907), VLYTIL (SEQ ID NO: 1908), VMYDAV (SEQ ID NO: 1909), VNYESI (SEQ ID NO: 1910), VNYSAL (SEQ ID NO: 1911), VNYSKI (SEQ ID NO: 1912), VNYSSI (SEQ ID NO: 1913), VPYALL (SEQ ID NO: 1914), VPYDTL (SEQ ID NO: 1915), VPYEDV (SEQ ID NO: 1916), VPYEEL (SEQ ID NO: 1917), VPYKTI (SEQ ID NO: 1918), VPYLRV (SEQ ID NO: 1919), VPYNDL (SEQ ID NO: 1920), VPYPAL (SEQ ID NO: 1921), VPYQEL (SEQ ID NO: 1922), VPYRLL (SEQ ID NO: 1923), VPYSEL (SEQ ID NO: 1924), VPYTLL (SEQ ID NO: 1925), VPYTPL (SEQ ID NO: 1926), VPYTTL (SEQ ID NO: 1927), VPYVEL (SEQ ID NO: 1928), VPYVMV (SEQ ID NO: 1929), VPYVSL (SEQ ID NO: 1930), VQYKAV (SEQ ID NO: 1931), VQYKEI (SEQ ID NO: 1932), VQYNIV (SEQ ID NO: 1933), VQYRPV (SEQ ID NO: 1934), VQYSQI (SEQ ID NO: 1935), VQYSTV (SEQ ID NO: 1936), VQYTEV (SEQ ID NO: 1937), VQYYNI (SEQ ID NO: 1938), VRYARL (SEQ ID NO: 1939), VRYDNL (SEQ ID NO: 1940), VRYGRI (SEQ ID NO: 1941), VRYKKL (SEQ ID NO: 1942), VRYKRV (SEQ ID NO: 1943), VRYLDV (SEQ ID NO: 1944), VRYRTI (SEQ ID NO: 1945), VRYSDI (SEQ ID NO: 1946), VRYTQL (SEQ ID NO: 1947), VRYVCL (SEQ ID NO: 1948), VSYAEL (SEQ ID NO: 1949), VSYASV (SEQ ID NO: 1950), VSYEPI (SEQ ID NO: 1951), VSYGDI (SEQ ID NO: 1952), VSYIGL (SEQ ID NO: 1953), VSYILV (SEQ ID NO: 1954), VSYMML (SEQ ID NO: 1955), VSYNNI (SEQ ID NO: 1956), VSYNNL (SEQ ID NO: 1957), VSYQEI (SEQ ID NO: 1958), VSYQPI (SEQ ID NO: 1959), VSYSAV (SEQ ID NO: 1960), VSYSFL (SEQ ID NO: 1961), VSYSLV (SEQ ID NO: 1962), VSYSPV (SEQ ID NO: 1963), VSYTML (SEQ ID NO: 1964), VSYTNL (SEQ ID NO: 1965), VSYTPL (SEQ ID NO: 1966), VSYVKI (SEQ ID NO: 1967), VSYVLL (SEQ ID NO: 1968), VTYADL (SEQ ID NO: 1969), VTYAEL (SEQ ID NO: 1970), VTYAEV (SEQ ID NO: 1971), VTYAKV (SEQ ID NO: 1972), VTYAPV (SEQ ID NO: 1973), VTYAQL (SEQ ID NO: 1974), VTYATL (SEQ ID NO: 1975), VTYATV (SEQ ID NO: 1976), VTYGNI (SEQ ID NO: 1977), VTYITI (SEQ ID NO: 1978), VTYQII (SEQ ID NO: 1979), VTYQIL (SEQ ID NO: 1980), VTYQLL (SEQ ID NO: 1981), VTYSAL (SEQ ID NO: 1982), VTYSTL (SEQ ID NO: 1983), VTYTLL (SEQ ID NO: 1984), VTYTQL (SEQ ID NO: 1985), VTYVNL (SEQ ID NO: 1986), VVYADI (SEQ ID NO: 1987), VVYEDV (SEQ ID NO: 1988), VVYFCL (SEQ ID NO: 1989), VVYKTL (SEQ ID NO: 1990), VVYQKL (SEQ ID NO: 1991), VVYSEV (SEQ ID NO: 1992), VVYSQV (SEQ ID NO: 1993), VVYSW (SEQ ID NO: 1994), VVYTVL (SEQ ID NO: 1995), VVYYRI (SEQ ID NO: 1996), VYYHWL (SEQ ID NO: 1997) or VYYLPL (SEQ ID NO: 1998).

48. The N-CAR according to any one of the preceding embodiments wherein the intracellular domain comprises several ITSMs having the same amino acid sequence.

49. The N-CAR according to any one of the preceding embodiments wherein the intracellular domain comprises several ITSMs having different amino acid sequences.

50. The N-CAR any one of the preceding embodiments wherein the intracellular domain comprises several ITIMs having the same amino acid sequence.

51. The N-CAR any one of the preceding embodiments wherein the intracellular domain comprises several ITIMs having different amino acid sequences.

52. The N-CAR according to any one of embodiments 7 to 51 wherein p is 1, 2, 3, 4, 5, 6, 7, 8, 9, 10, 11, 12, 13, 14, 15, 16, 17, 18, 19 or 20.

53. The N-CAR according to any one of embodiments 7 to 51 wherein p is 1.

54. The N-CAR according to any one of embodiments 7 to 51 wherein p is 2.

55. The N-CAR according to any one of embodiments 7 to 51 wherein p is 3.

56. The N-CAR according to any one of embodiments 7 to 51 wherein p is 4.

57. The N-CAR according to any one of embodiments 7 to 51 wherein p is 5.

58. The N-CAR according to any one of embodiments 7 to 57 wherein n is 0, 1, 2, 3, 4, 5, 6, 7, 8, 9, or 10.

59. The N-CAR according to any one of embodiments 7 to 57 wherein n is 0.

60. The N-CAR according to any one of embodiments 7 to 57 wherein n is 1.

61. The N-CAR according to any one of embodiments 7 to 57 wherein n is 2.

62. The N-CAR according to any one of embodiments 7 to 57 wherein n is 3.

63. The N-CAR according to any one of embodiments 7 to 62 wherein m is 1, 2, 3, 4, 5, 6, 7, 8, 9, 10, 11, 12, 13, 14, 15, 16, 17, 18, 19 or 20.

64. The N-CAR according to any one of embodiments 7 to 62 wherein m is 1, 2, 3, 4, 5, 6, 7, 8, 9, or 10.

65. The N-CAR according to any one of embodiments 7 to 62 wherein m is 1, 2, 3, 4 or 5.

66. The N-CAR according to any one of embodiments 7 to 62 wherein m is 1.

67. The N-CAR according to any one of embodiments 7 to 62 wherein m is 2.

68. The N-CAR according to any one of embodiments 7 to 62 wherein m is 3.

69. The N-CAR according to any one of embodiments 7 to 62 wherein m is 4.

70. The N-CAR according to any one of embodiments 7 to 62 wherein m is 5.

71. The N-CAR according to any one of embodiments 7 to 51 wherein n is 0, m is 1 to 6 and p is 1 and ITSM is TEYATI (SEQ ID NO: 937).

72. The N-CAR according to any one of embodiments 7 to 51 wherein n is 0, m is 1 to 6 and p is 1 and ITSM is TEYSEI (SEQ ID NO: 940).

73. The N-CAR according to any one of embodiments 7 to 51 wherein n is 0, m is 1 to 6 and p is 1 and ITSM is TEYASI (SEQ ID NO: 936).

74. The N-CAR according to any one of embodiments 7 to 51 wherein n is 1, m is 1 and p is 1 to 5 and ITIM is VDYGEL (SEQ ID NO: 1820) and ITSM is TEYATI (SEQ ID NO: 937).

75. The N-CAR according to any one of embodiments 7 to 51 wherein n is 1, m is 1 and p is 1 to 5 and ITIM is $LX_6YAX_8L$ (SEQ ID NO: 2041) wherein $X_6$ is selected from H or Q and $X_8$ is V or S, and ITSM is TEYSEI (SEQ ID NO: 940).

76. The N-CAR according to any one of embodiments 1 to 75 wherein the intracellular domain comprises several ITSMs having the same amino acid sequence.

77. The N-CAR according to any one of embodiments 1 to 75 wherein the intracellular domain comprises several ITSMs having different amino acid sequences.

78. The N-CAR according to any one of embodiments 1 to 75 wherein the intracellular domain comprises several ITIMs having the same amino acid sequence.

79. The N-CAR according to any one of embodiments 1 to 75 wherein the intracellular domain comprises several ITIMs having different amino acid sequences.

80. The N-CAR according to any one of embodiments 1 to 79, wherein the antigen binding domain is a single chain variable fragment (scFv).

81. The N-CAR according to any one of embodiments 1 to 79, wherein the antigen binding domain is a Fv, a Fab, or a (Fab')2.

82. The N-CAR according to any one of embodiments 1 to 81, wherein the antigen binding domain binds to ITGAX, CD1E, CD34, CD1C, CD123 or CD141.

83. The N-CAR according to any one of embodiments 1 to 81, wherein the antigen binding domain binds to ZP2, GABRA6, CRTAM or GRM4, or MDGA1.

84. The N-CAR according to any one of embodiments 1 to 81, wherein the antigen binding domain binds to SFTPC, ROS1, SLC6A4 or AGTR2.

85. The N-CAR according to any one of embodiments 1 to 81, wherein the antigen binding domain binds to LRRC26, HTR3A, TMEM211 or MRGPRX3.

86. The N-CAR according to any one of embodiments 1 to 81, wherein the antigen binding domain binds to MEP1B, TMIGD1, CEACAM20, or ALPI.

87. The N-CAR according to any one of embodiments 1 to 81, wherein the antigen binding domain binds to TMPRSS11B, CYP17A1 or ATP4B.

88. The N-CAR according to any one of embodiments 1 to 81, wherein the antigen binding domain binds to GP2, MUC21, CLCA4 and SLC27A6.

89. The N-CAR according to any one of embodiments 1 to 81, wherein the antigen binding domain binds to a cell-surface protein present in normal tissue but not present or present at lower level on a tumor 90. The N-CAR according to any one of embodiments 1 to 81 wherein the antigen binding domain binds to an off-tissue antigen.

91. The N-CAR according to any one of embodiments 1 to 90 wherein the transmembrane domain comprises the transmembrane region(s) of the alpha, beta or zeta chain of the T-cell receptor, PD-1, 4-1BB, OX40, ICOS, CTLA-4, LAG3, 2B4, BTLA4, TIM-3, TIGIT, SIRPA, CD28, CD3 epsilon, CD45, CD4, CD5, CD8, CD9, CD16, CD22, CD33, CD37, CD64, CD80, CD86, CD134, CD137 or CD154.

92. The N-CAR according to any one of embodiments 1 to 91 wherein the transmembrane domain comprises the transmembrane region of PD-1.

93. The N-CAR according to any one of embodiments 1 to 92 wherein the transmembrane domain comprises the transmembrane region(s) of CD8 alpha.

94. The N-CAR according to any one of embodiments 1 to 93 wherein the transmembrane domain is attached to the extracellular domain of the N-CAR via a hinge.

95. The N-CAR according to embodiment 94 wherein the hinge is a human immunoglobulin hinge.

96. The N-CAR according to embodiment 94 wherein the hinge is an IgG4 hinge, a CD8 alpha hinge or a PD-1 hinge.

96.1 The N-CAR according to embodiment 94 wherein the hinge is a PD-1 hinge.

97. An isolated immune cell comprising a P-CAR comprising,
an extracellular domain comprising an antigen binding domain,
a transmembrane domain
an intracellular domain
and an N-CAR according to any one of embodiments 1 to 96.

98. The immune cell according to embodiment 97, wherein the antigen to which the antigen binding domain of the P-CAR binds is CD33 and the antigen to which the antigen binding domain of the N-CAR binds is ITGAX, CD1E, CD34, CD1C, CD123, or CD141.

99. The immune cell according to embodiment 97, wherein the antigen to which the antigen binding domain of the P-CAR binds is FLT3 and the antigen to which the antigen binding domain of the N-CAR binds is ZP2, GABRA6, CRTAM, GRM4 or MDGA1.

100. The immune cell according to embodiment 97, wherein the antigen to which the antigen binding domain of the P-CAR binds is MSLN and the antigen to which the antigen binding domain of the N-CAR binds is SFTPC, ROS1, SLC6A4 or AGTR2.

101. The immune cell according to embodiment 97, wherein the antigen to which the antigen binding domain of the P-CAR binds is MUC16 and the antigen to which the antigen binding domain of the N-CAR binds is LRRC26, HTR3A, TMEM211 or MRGPRX3.

102. The immune cell according to embodiment 97, wherein the antigen to which the antigen binding domain of the P-CAR binds is MUC17 and the antigen to which the antigen binding domain of the N-CAR binds is MEP1B, TMIGD1, CEACAM20 or ALPI.

103. The immune cell according to embodiment 97, wherein the antigen to which the antigen binding domain of the P-CAR binds is present in tumor cells of pancreatic ductal adenocarcinoma and the antigen to which the antigen binding domain of the N-CAR binds is TMPRSS11B, CYP17A1 or ATP4B.

104. The immune cell according to embodiment 97, wherein the antigen to which the antigen binding domain of the P-CAR binds is present in tumor cells of kidney clear cell carcinoma and the antigen to which the antigen binding domain of the N-CAR binds is GP2, MUC21, CLCA4 and SLC27A6.

105. The immune cell according to any one of embodiments 97 to 104 wherein the immune cell is a T-cell.

106. The immune cell according to embodiment 105 wherein the T-cell is a human T-cell.

107. The immune cell according to any one of embodiments 97 to 106 for its use as a medicament.

108. The immune cell according to any one of embodiments 97 to 106 for its use for the treatment of cancer.

109. The immune cell according to any one of embodiments 97 to 106 derived from inflammatory T-lymphocytes, cytotoxic T-lymphocytes, regulatory T-lymphocytes or helper T-lymphocytes.

110. A method of engineering an immune cell according to any one of embodiments 97 to 109 comprising: (a) Providing an immune cell; (b) expressing the N-CAR and the P-CAR at the surface of said cells.

111. A method of engineering an immune cell of embodiment 110 comprising: (a) providing an immune cell; (b) introducing into said cell at least one polynucleotide encoding the N-CAR and at least one polynucleotide encoding the P-CAR; (c) expressing said polynucleotides into said cell.

112. A method for treating a patient in need thereof comprising: a) providing an immune cell according to any one of embodiments 97 to 109, and; b) administrating said T-cells to said patient.

113. The method for treating a patient of embodiment 112 wherein said immune cells are recovered from donors.

114. The method for treating a patient of embodiment 113 wherein said immune cells are recovered from patients.

115. The immune cell according to any one of embodiments 97 to 109 wherein the reduction of activation of the immune cells when both the P-CAR and N-CAR bind to their respective antigens is increased, preferably by at least 5%, 10%, 15%, 20% or 30% as compared to the same immune cell comprising an N-CAR comprising the full intracellular domain of PD-1.

116. The immune cell according to any one of embodiments 97 to 109 wherein the reduction of activation of the immune cells when both the P-CAR and N-CAR bind to their respective antigens is increased, preferably by at least 5%, 10%, 15%, 20% or 30% as compared to the same immune cell comprising an N-CAR comprising the full intracellular domain of CTLA-4.

117. The immune cell according to any one of embodiments 97 to 109 wherein the activation of the immune cells is reduced by at least 5%, 10%, 15%, 20%, 25%, 30%, 35%, 40%, 45%, 50%, 55%, 60%, 65%, 70%, 75%, 80%, 85% when the N-CAR and P-CAR antigen binding domains both binds to their respective antigens as compared to when only the P-CAR antigen binding domain binds to its antigen.

118. The immune cell according to any one of embodiments 115 to 117 wherein the level of activation of the immune cell is determined by measuring cytokine production.

119. The immune cell according to embodiment 118 wherein the cytokine is IFNgamma or TNFalpha.

120. The immune cell according to embodiment 118 or 119 wherein the cytokine production is measured by ELISA and/or FACS and/or luminex.

121. The immune cell according to any one of embodiments 115 to 117 wherein the level of activation of the immune cell is determined by the level of degranulation.

122. The immune cell according to embodiment 121 wherein degranulation is measured by measuring expression of CD107a by FACS.

123. The immune cell according to embodiment 115 to 117 wherein the level of activation of the immune cell is measured by monitoring the ability of the immune cell to kill target cells.

124. The immune cell according to any one of embodiments 115 to 117 wherein the level of activation of the immune cell is determined by monitoring the luciferase activity in reporter cells incorporating inducible NFAT- or NfkB-regulated luciferase expression.

125. The immune cell according to any one of embodiments 115 to 117 wherein the level of activation of the immune cell is determined by monitoring the luciferase activity in reporter cells incorporating inducible NFAT- or NfkB-regulated luciferase expression as disclosed in Example 3.

126. A polynucleotide comprising a nucleic acid sequence encoding an N-CAR according to any one of embodiments 1 to 96.

127. A vector comprising a polynucleotide according to embodiment 124.

SEQUENCE LISTING (2050 sequences)

SEQ ID NO: 1 - protein, 10 aa, Artificial Sequence
  Description of Artificial Sequence: Synthetic peptide
ELFANKRKYT

SEQ ID NO: 2 - protein, 11 aa, Artificial Sequence
  Description of Artificial Sequence: Synthetic peptide
RKRNNSRLGNG

SEQ ID NO: 3 - protein, 11 aa, Artificial Sequence
  Description of Artificial Sequence: Synthetic peptide
YRHRKKRNGLT

SEQ ID NO: 4 - protein, 22 aa, Artificial Sequence
  Description of Artificial Sequence: Synthetic peptide
YKMYGSEMLHKRDPLDEDEDTD

SEQ ID NO: 5 - protein, 24 aa, Artificial Sequence
  Description of Artificial Sequence: Synthetic peptide
LRKRRDSLSLSTQRTQGPAESARN

SEQ ID NO: 6 - protein, 25 aa, Artificial Sequence
  Description of Artificial Sequence: Synthetic peptide
WRMMKYQQKAAGMSPEQVLQPLEGD

SEQ ID NO: 7 - protein, 29 aa, Artificial Sequence
  Description of Artificial Sequence: Synthetic peptide
CSRAARGTIGARRTGQPLKEDPSAVPVFS

SEQ ID NO: 8 - protein, 32 aa, Artificial Sequence
  Description of Artificial Sequence: Synthetic polypeptide
RIRQKKAQGSTSSTRLHEPEKNAREITQDTND

SEQ ID NO: 9 - protein, 44 aa, Artificial Sequence
  Description of Artificial Sequence: Synthetic polypeptide
NNSYQEIEEDADVEWKFARAKLWLSYFDEGRTLPAPFNLVPSPK

SEQ ID NO: 10 - protein, 45 aa, Artificial Sequence
  Description of Artificial Sequence: Synthetic polypeptide
WLHRRLPPQPIRPLPRFAPLVKTEPQRPVKEEEPKIPGDLDQEPS

SEQ ID NO: 11 - protein, 49 aa, Artificial Sequence
  Description of Artificial Sequence: Synthetic polypeptide
SNKCDVVVVGGGISGMAAAKLLHDSGLNVVVLEARDRVGGRTYTLRNQK

SEQ ID NO: 12 - protein, 55 aa, Artificial Sequence
  Description of Artificial Sequence: Synthetic polypeptide
KTHRRKAARTAVGRNDTHPTTGSASPKHQKKSKLHGPTETSSCSGAAPTVEMDEE

SEQ ID NO: 13 - protein, 55 aa, Artificial Sequence
  Description of Artificial Sequence: Synthetic polypeptide
RVKTRRKKAAQPVQNTDDVNPVMVSGSRGHQHQFQTGIVSDHPAEAGPISEDEQE

SEQ ID NO: 14 - protein, 55 aa, Artificial Sequence
  Description of Artificial Sequence: Synthetic polypeptide
KARRKQAAGRPEKMDDEDPIMGTITSGSRKKPWPDSPGDQASPPGDAPPLEEQKE

SEQ ID NO: 15 - protein, 57 aa, Artificial Sequence
  Description of Artificial Sequence: Synthetic polypeptide
KICRKEARKRAAAEQDVPSTLGPISQGHQHECSAGSSQDHPPPGAATYTPGKGEEQE

SEQ ID NO: 16 - protein, 59 aa, Artificial Sequence
  Description of Artificial Sequence: Synthetic polypeptide
MENQEKASIAGHMFDVVVIGGGISGLSAAKLLTEYGVSVLVLEARDRVGGRTYTIRNEH

SEQ ID NO: 17 - protein, 61 aa, Artificial Sequence
  Description of Artificial Sequence: Synthetic polypeptide
VRSCRKKSARPAAGVGDTGIEDANAVRGSASQGPLTEPWAEDSPPDQPPPASARSSVGEGE

SEQ ID NO: 18 - protein, 67 aa, Artificial Sequence
  Description of Artificial Sequence: Synthetic polypeptide
KCYFLRKAKAKQMPVEMSRPAVPLLNSNNEKMSDPNMEANSHYGHNDDVRNHAMKPINDNKEPLNSD

SEQ ID NO: 19 - protein, 70 aa, Artificial Sequence
  Description of Artificial Sequence: Synthetic polypeptide
VRLRLQKHRPPADPCRGETETMNNLANCQREKDISVSIIGATQIKNTNKKADFHGDHSADKNGFKARYPA

SEQ ID NO: 20 - protein, 76 aa, Artificial Sequence
  Description of Artificial Sequence: Synthetic polypeptide
RRHQGKQNELSDTAGREINLVDAHLKSEQTEASTRQNSQVLLSETGIYDNDPDLCFRMQEGSEVYSNPCLEENKPG

SEQ ID NO: 21 - protein, 85 aa, Artificial Sequence
  Description of Artificial Sequence: Synthetic polypeptide
QSVFNKRKSRVRHYLVKCPQNSSGETVTSVTSLAPLQPKKGKRQKEKPDIPPAVPAKAPIAPTFHKPKLLKPQRKVTLPKIAEEN

SEQ ID NO: 22 - protein, 114 aa, Artificial Sequence
  Description of Artificial Sequence: Synthetic polypeptide
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTV

SEQ ID NO: 23 - protein, 114 aa, Artificial Sequence
  Description of Artificial Sequence: Synthetic polypeptide
MTEKMSSFLYIGDIVSLYAEGSVNGFISTLGLVDDRCVVHPEAGDLANPPKKFRDCLFKVCPMNRYSAQKQYWKAKQAKQGNHTEAALLKKLQHAAELEQKQNESENKKLLGEI

SEQ ID NO: 24 - protein, 115 aa, Artificial Sequence
  Description of Artificial Sequence: Synthetic polypeptide
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDV

SEQ ID NO: 25 - protein, 144 aa, Artificial Sequence
  Description of Artificial Sequence: Synthetic polypeptide
NCVSCCKDPEIDFKEFEDNFDDEIDFTPPAEDTPSVQSPAEVFTLSVPNISLPAPSQFQPSVEGLKSQVARHSLNYIQEIGNGWFGKVLLGEIYTGTSVARVIVKELKASANPKEQDTFLKNGEPYYILQHPNILQCVGQCVEA

SEQ ID NO: 26 - protein, 156 aa, Artificial Sequence
  Description of Artificial Sequence: Synthetic polypeptide
KRVQETKFGNAFTEEDSELVVNYIAKKSFCRRAIELTLHSLGVSEELQNKLEDVVIDRNLLILGKILGEGEFGSVMEGNLKQEDGTSLKVAVKTMKLDNSSQREIEEFLSEAACMKDFSHPNVIRLLGVCIEMSSQGIPKPMVILPFMKYGDLHTY

SEQ ID NO: 27 - protein, 159 aa, Artificial Sequence
  Description of Artificial Sequence: Synthetic polypeptide
HRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSF

SEQ ID NO: 28 - protein, 164 aa, Artificial Sequence
  Description of Artificial Sequence: Synthetic polypeptide
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEGACEDPHDLLATPTPELLLDWRQSAEEVIVKLRVGVGPLQLEDVDAAFTDTDCVVRFAGGQQWGG

SEQ ID NO: 29 - protein, 186 aa, Artificial Sequence
  Description of Artificial Sequence: Synthetic polypeptide
AYKRKSRESDLTLKRLQMQMDNLESRVALECKEAFAELQTDIHELTSDLDGAGIPFLDYRTYTMRVLFPGIEDHPVLRDLEVPGYRQERVEKGLKLFAQLINNKVFLLSFIRTLESQRSFSMRDRGNVASLIMTVLQSKLEYATDVLKQLLADLIDKNLESKNHPKLLLRRTESVAEKMLTNWFTF

SEQ ID NO: 30 - protein, 196 aa, Artificial Sequence
  Description of Artificial Sequence: Synthetic polypeptide
YKRKTQDADRTLKRLQLQMDNLESRVALECKEAFAELQTDINELTNHMDEVQIPFLDYRTYAVRVLFPGIEAHPVLKELDTPPNVEKALRLFGQLLHSRAFVLTFIHTLEAQSSFSMRDRGTVASLTMVALQSRLDYATGLLKQLLADLIEKNLESKNHPKLLLRRTESVAEKMLTNWFTFLLHKFLKECAGEPLF

SEQ ID NO: 31 - protein, 197 aa, Artificial Sequence
  Description of Artificial Sequence: Synthetic polypeptide
RWHCPRRLLGACWTLNGQEEPVSQPTPQLENEVSRQHLPATLPEMVAFYQELHTPTQGQTMVRQLMHKLLVFSAREVDHRGGCLMLQDTGISLLIPPGAVAVGRQERVSLILVWDLSDAPSLSQAQGLVSPVVACGPHGASFLKPCTLTFKHCAEQPSHARTYSSNTTLLDAKVWRPLGRPGAHASRDECRIHLSHF

SEQ ID NO: 32 - protein, 202 aa, Artificial Sequence
  Description of Artificial Sequence: Synthetic polypeptide
KQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSYVILSFENNGDYMDMKQADTTQYVPMLERKEV

SEQ ID NO: 33 - protein, 252 aa, Artificial Sequence
  Description of Artificial Sequence: Synthetic polypeptide
MFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTAQALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGDTLEPLST

SEQ ID NO: 34 - protein, 260 aa, Artificial Sequence
  Description of Artificial Sequence: Synthetic polypeptide
CCDCGGAPRSAAGFEPVPECSDGAIHSWAVEGPQPEPRDITTVIPQIPPDNANIIECIDNSGVYTNEYGGREMQDLGGGERMTGFELTEGVKTSGMPEICQEYSGTLRRNSMRECREGGLNMNFMESYFCQKAYAYADEDEGRPSNDCLLIYDIEGVGSPAGSVGCCSFIGEDLDDSFLDTLGPKFKKLADISLGKESYPDLDPSWPPQSTEPVCLPQETEPVVSGHPPISPHFGTTTVISESTYPSGPGVLHPKPILDP

SEQ ID NO: 35 - protein, 371 aa, Artificial Sequence
  Description of Artificial Sequence: Synthetic polypeptide
MADGGEGEDEIQFLRTDDEVVLQCTATIHKEQQKLCLAAEGFGNRLCFLESTSNSKNVPPDLSICTFVLEQSLSVRALQEMLANTVEKSEGQVDVEKWKFMMKTAQGGGHRTLLYGHAILLRHSYSGMYLCCLSTSRSSTDKLAFDVGLQEDTTGEACWWTIHPASKQRSEGEKVRVGDDLILVSVSSERYLHLSYGNGSLHVDAAFQQTLWSVAPISSGSEAAQGYLIGGDVLRLLHGHMDECLTVPSGEHGEEQRRTVHYEGGAVSVHARSLWRLETLRVAWSGSHIRWGQPFRLRHVTTGKYLSLMEDKNLLLMDKEKADVKSTAFTFRSSKEKLDVGVRKEVDGMGTSEIKYGDSVCYIQHVDTGLW

SEQ ID NO: 36 - protein, 519 aa, Artificial Sequence
  Description of Artificial Sequence: Synthetic polypeptide
MGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVN

SEQ ID NO: 37 - protein, 41 aa, Artificial Sequence
  Description of Artificial Sequence: Synthetic polypeptide
AVSLSKMLKKRSPLTTGVYVKMPPTEPECEKQFQPYFIPIN

SEQ ID NO: 38 - protein, 54 aa, Artificial Sequence
  Description of Artificial Sequence: Synthetic polypeptide
HLWRRQWRPRRFSALEQGIHPPQAQSKIEELEQEPEPEPEPEPEPEPEPEPEQL

SEQ ID NO: 39 - protein, 78 aa, Artificial Sequence
  Description of Artificial Sequence: Synthetic polypeptide
FKWYSHSKEKIQNLSLISLANLPPSGLANAVAEGIRSEENIYTIEENVYEVEEPNEYYCYVSSRQQPSQPLGCRFAMP

SEQ ID NO: 40 - protein, 101 aa, Artificial Sequence
  Description of Artificial Sequence: Synthetic polypeptide
HRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 41 - protein, 84 aa, Artificial Sequence
  Description of Artificial Sequence: Synthetic polypeptide
HRWCSNKKNAAVMDQESAGNRTANSEDSDEQDPQEVTYTQLNHCVFTQRKITRPSQRPKTPPTDIIVYAELPNAESRSKVVSCP

SEQ ID NO: 42 - protein, 4 aa, Artificial Sequence
  Description of Artificial Sequence: Synthetic peptide
RRRP

SEQ ID NO: 43 - protein, 4 aa, Artificial Sequence
  Description of Artificial Sequence: Synthetic peptide
MSEE

SEQ ID NO: 44 - protein, 4 aa, Artificial Sequence
  Description of Artificial Sequence: Synthetic peptide
MTSE

SEQ ID NO: 45 - protein, 4 aa, Artificial Sequence
  Description of Artificial Sequence: Synthetic peptide
DRYL

SEQ ID NO: 46 - protein, 4 aa, Artificial Sequence
  Description of Artificial Sequence: Synthetic peptide
MTDS

SEQ ID NO: 47 - protein, 4 aa, Artificial Sequence
  Description of Artificial Sequence: Synthetic peptide
AAKP

SEQ ID NO: 48 - protein, 4 aa, Artificial Sequence
  Description of Artificial Sequence: Synthetic peptide
QHFS

SEQ ID NO: 49 - protein, 4 aa, Artificial Sequence
  Description of Artificial Sequence: Synthetic peptide
MKPK

SEQ ID NO: 50 - protein, 4 aa, Artificial Sequence
  Description of Artificial Sequence: Synthetic peptide
IAAL

SEQ ID NO: 51 - protein, 4 aa, Artificial Sequence
  Description of Artificial Sequence: Synthetic peptide
CLNP

SEQ ID NO: 52 - protein, 4 aa, Artificial Sequence
  Description of Artificial Sequence: Synthetic peptide
QKVL

SEQ ID NO: 53 - protein, 5 aa, Artificial Sequence
  Description of Artificial Sequence: Synthetic peptide
DRYQS

SEQ ID NO: 54 - protein, 5 aa, Artificial Sequence
  Description of Artificial Sequence: Synthetic peptide
LKAKD

SEQ ID NO: 55 - protein, 5 aa, Artificial Sequence
  Description of Artificial Sequence: Synthetic peptide
DRYYA

SEQ ID NO: 56 - protein, 5 aa, Artificial Sequence
  Description of Artificial Sequence: Synthetic peptide
MSYYG

SEQ ID NO: 57 - protein, 5 aa, Artificial Sequence
  Description of Artificial Sequence: Synthetic peptide
SSSKP

SEQ ID NO: 58 - protein, 5 aa, Artificial Sequence
  Description of Artificial Sequence: Synthetic peptide
LKIRH

SEQ ID NO: 59 - protein, 5 aa, Artificial Sequence
  Description of Artificial Sequence: Synthetic peptide
DVRHV

SEQ ID NO: 60 - protein, 5 aa, Artificial Sequence
  Description of Artificial Sequence: Synthetic peptide
DRFYA

SEQ ID NO: 61 - protein, 5 aa, Artificial Sequence
  Description of Artificial Sequence: Synthetic peptide
EGWRI

SEQ ID NO: 62 - protein, 5 aa, Artificial Sequence
  Description of Artificial Sequence: Synthetic peptide
SDIKR

SEQ ID NO: 63 - protein, 6 aa, Artificial Sequence
  Description of Artificial Sequence: Synthetic peptide
LHHKKY

SEQ ID NO: 64 - protein, 6 aa, Artificial Sequence
  Description of Artificial Sequence: Synthetic peptide
TVDRYL

SEQ ID NO: 65 - protein, 6 aa, Artificial Sequence
  Description of Artificial Sequence: Synthetic peptide
SSPTFR

SEQ ID NO: 66 - protein, 6 aa, Artificial Sequence
  Description of Artificial Sequence: Synthetic peptide
WRRAGH

SEQ ID NO: 67 - protein, 6 aa, Artificial Sequence
  Description of Artificial Sequence: Synthetic peptide
YRVDLV

SEQ ID NO: 68 - protein, 6 aa, Artificial Sequence
  Description of Artificial Sequence: Synthetic peptide
NSFDLA

SEQ ID NO: 69 - protein, 6 aa, Artificial Sequence
  Description of Artificial Sequence: Synthetic peptide
YRSGIT

SEQ ID NO: 70 - protein, 6 aa, Artificial Sequence
  Description of Artificial Sequence: Synthetic peptide
YRLGLT

SEQ ID NO: 71 - protein, 6 aa, Artificial Sequence
  Description of Artificial Sequence: Synthetic peptide
QHIMAI

SEQ ID NO: 72 - protein, 6 aa, Artificial Sequence
  Description of Artificial Sequence: Synthetic peptide
NSCANP

SEQ ID NO: 73 - protein, 6 aa, Artificial Sequence
  Description of Artificial Sequence: Synthetic peptide
RRFCAT

SEQ ID NO: 74 - protein, 7 aa, Artificial Sequence
  Description of Artificial Sequence: Synthetic peptide
GDMANNS

SEQ ID NO: 75 - protein, 7 aa, Artificial Sequence
  Description of Artificial Sequence: Synthetic peptide
MAYQSLR

SEQ ID NO: 76 - protein, 7 aa, Artificial Sequence
  Description of Artificial Sequence: Synthetic peptide
TARNLTV

SEQ ID NO: 77 - protein, 7 aa, Artificial Sequence
  Description of Artificial Sequence: Synthetic peptide
MERAEEP

SEQ ID NO: 78 - protein, 7 aa, Artificial Sequence
  Description of Artificial Sequence: Synthetic peptide
SMDRFLA

SEQ ID NO: 79 - protein, 7 aa, Artificial Sequence
  Description of Artificial Sequence: Synthetic peptide
LRLAAAP

SEQ ID NO: 80 - protein, 7 aa, Artificial Sequence
  Description of Artificial Sequence: Synthetic peptide
LRLFAAP

SEQ ID NO: 81 - protein, 7 aa, Artificial Sequence
  Description of Artificial Sequence: Synthetic peptide
KRLIALS

SEQ ID NO: 82 - protein, 8 aa, Artificial Sequence
  Description of Artificial Sequence: Synthetic peptide
YSNSSVNP

SEQ ID NO: 83 - protein, 8 aa, Artificial Sequence
  Description of Artificial Sequence: Synthetic peptide
YANSCVNP

SEQ ID NO: 84 - protein, 8 aa, Artificial Sequence
  Description of Artificial Sequence: Synthetic peptide
KLSPRVKR

SEQ ID NO: 85 - protein, 8 aa, Artificial Sequence
  Description of Artificial Sequence: Synthetic peptide
KIRLRCQS

SEQ ID NO: 86 - protein, 6 aa, Artificial Sequence
  Description of Artificial Sequence: Synthetic peptide
TAYELV

SEQ ID NO: 87 - protein, 8 aa, Artificial Sequence
  Description of Artificial Sequence: Synthetic peptide
MASESSPL

SEQ ID NO: 88 - protein, 8 aa, Artificial Sequence
  Description of Artificial Sequence: Synthetic peptide
KTANEGGS

SEQ ID NO: 89 - protein, 8 aa, Artificial Sequence
  Description of Artificial Sequence: Synthetic peptide
DFAKEGHS

SEQ ID NO: 90 - protein, 8 aa, Artificial Sequence
  Description of Artificial Sequence: Synthetic peptide
DHVRRKDS

SEQ ID NO: 91 - protein, 8 aa, Artificial Sequence
  Description of Artificial Sequence: Synthetic peptide
DNVKKENS

SEQ ID NO: 92 - protein, 8 aa, Artificial Sequence
  Description of Artificial Sequence: Synthetic peptide
VMWKHRYQ

SEQ ID NO: 93 - protein, 8 aa, Artificial Sequence
  Description of Artificial Sequence: Synthetic peptide
KMYYSRRG

SEQ ID NO: 94 - protein, 9 aa, Artificial Sequence
  Description of Artificial Sequence: Synthetic peptide
DRYIAIRIP

SEQ ID NO: 95 - protein, 9 aa, Artificial Sequence
  Description of Artificial Sequence: Synthetic peptide
DRYLAICVP

SEQ ID NO: 96 - protein, 9 aa, Artificial Sequence
  Description of Artificial Sequence: Synthetic peptide
DRYLRVKLT

SEQ ID NO: 97 - protein, 9 aa, Artificial Sequence
  Description of Artificial Sequence: Synthetic peptide
DRYIGVSYP

SEQ ID NO: 98 - protein, 9 aa, Artificial Sequence
  Description of Artificial Sequence: Synthetic peptide
DRYIGVRYS

SEQ ID NO: 99 - protein, 9 aa, Artificial Sequence
  Description of Artificial Sequence: Synthetic peptide
DRYVGVRHS

SEQ ID NO: 100 - protein, 9 aa, Artificial Sequence
  Description of Artificial Sequence: Synthetic peptide
DRYLAVTNP

SEQ ID NO: 101 - protein, 9 aa, Artificial Sequence
  Description of Artificial Sequence: Synthetic peptide
MPFHPVTAA

SEQ ID NO: 102 - protein, 9 aa, Artificial Sequence
  Description of Artificial Sequence: Synthetic peptide
DRYISIHRP

SEQ ID NO: 103 - protein, 9 aa, Artificial Sequence
  Description of Artificial Sequence: Synthetic peptide
MQLKILVSA

SEQ ID NO: 104 - protein, 9 aa, Artificial Sequence
  Description of Artificial Sequence: Synthetic peptide
WKQRRAKEK

SEQ ID NO: 105 - protein, 9 aa, Artificial Sequence
  Description of Artificial Sequence: Synthetic peptide
DRFIAVVHP

SEQ ID NO: 106 - protein, 9 aa, Artificial Sequence
  Description of Artificial Sequence: Synthetic peptide
DRYIAITKP

SEQ ID NO: 107 - protein, 9 aa, Artificial Sequence
  Description of Artificial Sequence: Synthetic peptide
NRYCYICHS

SEQ ID NO: 108 - protein, 9 aa, Artificial Sequence
  Description of Artificial Sequence: Synthetic peptide
DRYLAITKP

SEQ ID NO: 109 - protein, 9 aa, Artificial Sequence
  Description of Artificial Sequence: Synthetic peptide
DRYCAVMDP

SEQ ID NO: 110 - protein, 9 aa, Artificial Sequence
  Description of Artificial Sequence: Synthetic peptide
DRYISIFYA

SEQ ID NO: 111 - protein, 9 aa, Artificial Sequence
  Description of Artificial Sequence: Synthetic peptide
DRYITIFHA

SEQ ID NO: 112 - protein, 9 aa, Artificial Sequence
  Description of Artificial Sequence: Synthetic peptide
NRYCYICHS

SEQ ID NO: 113 - protein, 9 aa, Artificial Sequence
  Description of Artificial Sequence: Synthetic peptide
WKKICNKSS

SEQ ID NO: 114 - protein, 9 aa, Artificial Sequence
  Description of Artificial Sequence: Synthetic peptide
WCYRKRYFV

SEQ ID NO: 115 - protein, 9 aa, Artificial Sequence
  Description of Artificial Sequence: Synthetic peptide
AHSNSCLNP

SEQ ID NO: 116 - protein, 9 aa, Artificial Sequence
  Description of Artificial Sequence: Synthetic peptide
PVFYKLGIT

SEQ ID NO: 117 - protein, 10 aa, Artificial Sequence
  Description of Artificial Sequence: Synthetic peptide
KFHRSRRLLG

SEQ ID NO: 118 - protein, 10 aa, Artificial Sequence
  Description of Artificial Sequence: Synthetic peptide
VDRYLRVKIP

SEQ ID NO: 119 - protein, 10 aa, Artificial Sequence
  Description of Artificial Sequence: Synthetic peptide
FERSCRKENM

SEQ ID NO: 120 - protein, 10 aa, Artificial Sequence
  Description of Artificial Sequence: Synthetic peptide
LPSIYLVFLI

SEQ ID NO: 121 - protein, 10 aa, Artificial Sequence
  Description of Artificial Sequence: Synthetic peptide
SSKTFQTWQS

SEQ ID NO: 122 - protein, 10 aa, Artificial Sequence
  Description of Artificial Sequence: Synthetic peptide
IDRYIAVCHP

SEQ ID NO: 123 - protein, 10 aa, Artificial Sequence
  Description of Artificial Sequence: Synthetic peptide
SFCLRNLFFP

SEQ ID NO: 124 - protein, 10 aa, Artificial Sequence
  Description of Artificial Sequence: Synthetic peptide
LLKTAKEGGS

SEQ ID NO: 125 - protein, 10 aa, Artificial Sequence
  Description of Artificial Sequence: Synthetic peptide
MWRNSKVMNI

SEQ ID NO: 126 - protein, 11 aa, Artificial Sequence
  Description of Artificial Sequence: Synthetic peptide
VEKKLFIHEYI

SEQ ID NO: 127 - protein, 11 aa, Artificial Sequence
  Description of Artificial Sequence: Synthetic peptide
RKRNNSRLGNG

SEQ ID NO: 128 - protein, 11 aa, Artificial Sequence
  Description of Artificial Sequence: Synthetic peptide
QRITVHVTRRP

SEQ ID NO: 129 - protein, 12 aa, Artificial Sequence
  Description of Artificial Sequence: Synthetic peptide
MEAAHAKTTEEC

SEQ ID NO: 130 - protein, 12 aa, Artificial Sequence
  Description of Artificial Sequence: Synthetic peptide
MARISFSYLCPA

SEQ ID NO: 131 - protein, 12 aa, Artificial Sequence
  Description of Artificial Sequence: Synthetic peptide
CCKRQKGKPKRK

SEQ ID NO: 132 - protein, 12 aa, Artificial Sequence
  Description of Artificial Sequence: Synthetic peptide
MTGDKGPQRLSG

SEQ ID NO: 133 - protein, 13 aa, Artificial Sequence
  Description of Artificial Sequence: Synthetic peptide
PDIPQSVKNKVLE

SEQ ID NO: 134 - protein, 13 aa, Artificial Sequence
  Description of Artificial Sequence: Synthetic peptide
KIFKIDIVLWYRD

SEQ ID NO: 135 - protein, 13 aa, Artificial Sequence
  Description of Artificial Sequence: Synthetic peptide
TEYVVRLWSAGCR

SEQ ID NO: 136 - protein, 13 aa, Artificial Sequence
  Description of Artificial Sequence: Synthetic peptide
QSKSELSHYTFYF

SEQ ID NO: 137 - protein, 10 aa, Artificial Sequence
  Description of Artificial Sequence: Synthetic peptide
SIVAYKQVPL

SEQ ID NO: 138 - protein, 13 aa, Artificial Sequence
  Description of Artificial Sequence: Synthetic peptide
SLDFFGSQNTQDD

SEQ ID NO: 139 - protein, 14 aa, Artificial Sequence
  Description of Artificial Sequence: Synthetic peptide
LWLHNGRSCFGVNR

SEQ ID NO: 140 - protein, 14 aa, Artificial Sequence
  Description of Artificial Sequence: Synthetic peptide
RFLRLNLKPDLSDT

SEQ ID NO: 141 - protein, 14 aa, Artificial Sequence
  Description of Artificial Sequence: Synthetic peptide
REHQRSGSYHVREE

SEQ ID NO: 142 - protein, 14 aa, Artificial Sequence
  Description of Artificial Sequence: Synthetic peptide
MITLTELKCLADAQ

SEQ ID NO: 143 - protein, 14 aa, Artificial Sequence
  Description of Artificial Sequence: Synthetic peptide
YNLTRLCRWDKRLL

SEQ ID NO: 144 - protein, 14 aa, Artificial Sequence
  Description of Artificial Sequence: Synthetic peptide
AFMNENFKKNVLSA

SEQ ID NO: 145 - protein, 15 aa, Artificial Sequence
  Description of Artificial Sequence: Synthetic peptide
MIYRLAQAEERQQLE

SEQ ID NO: 146 - protein, 15 aa, Artificial Sequence
  Description of Artificial Sequence: Synthetic peptide
KFRKNFWKLVKDIGC

SEQ ID NO: 147 - protein, 15 aa, Artificial Sequence
  Description of Artificial Sequence: Synthetic peptide
ALALAALAAVEPACG

SEQ ID NO: 148 - protein, 15 aa, Artificial Sequence
  Description of Artificial Sequence: Synthetic peptide
KKIAAATETAAQENA

SEQ ID NO: 149 - protein, 15 aa, Artificial Sequence
  Description of Artificial Sequence: Synthetic peptide
YRKVSKAEEAAQENA

SEQ ID NO: 150 - protein, 15 aa, Artificial Sequence
  Description of Artificial Sequence: Synthetic peptide
LKDFSILLMEGVPKS

SEQ ID NO: 151 - protein, 15 aa, Artificial Sequence
  Description of Artificial Sequence: Synthetic peptide
TVATAVEQYVPSEKL

SEQ ID NO: 152 - protein, 16 aa, Artificial Sequence
  Description of Artificial Sequence: Synthetic peptide
MGRQKELVSRCGEMLH

SEQ ID NO: 153 - protein, 16 aa, Artificial Sequence
  Description of Artificial Sequence: Synthetic peptide
CKRRRGQSPQSSPDLP

SEQ ID NO: 154 - protein, 16 aa, Artificial Sequence
  Description of Artificial Sequence: Synthetic peptide
LLEGVHLFLTARNLTV

SEQ ID NO: 155 - protein, 16 aa, Artificial Sequence
  Description of Artificial Sequence: Synthetic peptide
EERERKHHLKHGPNAP

SEQ ID NO: 156 - protein, 16 aa, Artificial Sequence
  Description of Artificial Sequence: Synthetic peptide
PLTHRLLCSEEPPRLH

SEQ ID NO: 157 - protein, 16 aa, Artificial Sequence
  Description of Artificial Sequence: Synthetic peptide
LYLLVRKHINRAHTAL

SEQ ID NO: 158 - protein, 16 aa, Artificial Sequence
  Description of Artificial Sequence: Synthetic peptide
KLPLWGQPSDQNCYDD

SEQ ID NO: 159 - protein, 17 aa, Artificial Sequence
  Description of Artificial Sequence: Synthetic peptide
MYRLKVLQMRLRSAITG

SEQ ID NO: 160 - protein, 17 aa, Artificial Sequence
  Description of Artificial Sequence: Synthetic peptide
SMRGTICNPGPRKSMSK

SEQ ID NO: 161 - protein, 17 aa, Artificial Sequence
  Description of Artificial Sequence: Synthetic peptide
RILVRKLEPAQGSLHTQ

SEQ ID NO: 162 - protein, 16 aa, Artificial Sequence
  Description of Artificial Sequence: Synthetic peptide
SRYATLMQKDSSQETT

SEQ ID NO: 163 - protein, 17 aa, Artificial Sequence
  Description of Artificial Sequence: Synthetic peptide
SSHFGCQLVCCQSSNVS

SEQ ID NO: 164 - protein, 17 aa, Artificial Sequence
  Description of Artificial Sequence: Synthetic peptide
RILMRKLRTQETRGNEV

SEQ ID NO: 165 - protein, 17 aa, Artificial Sequence
  Description of Artificial Sequence: Synthetic peptide
RILLQKLRPPDIRKSDS

SEQ ID NO: 166 - protein, 17 aa, Artificial Sequence
  Description of Artificial Sequence: Synthetic peptide
RILLQKLTSPDVGGNDQ

SEQ ID NO: 167 - protein, 18 aa, Artificial Sequence
  Description of Artificial Sequence: Synthetic peptide
RSVRPCFTQAAFLKSKYW

SEQ ID NO: 168 - protein, 18 aa, Artificial Sequence
  Description of Artificial Sequence: Synthetic peptide
RSGRGRKLSGDQITLPTT

SEQ ID NO: 169 - protein, 18 aa, Artificial Sequence
  Description of Artificial Sequence: Synthetic peptide
MAAENEASQESALGAYSP

SEQ ID NO: 170 - protein, 18 aa, Artificial Sequence
  Description of Artificial Sequence: Synthetic peptide
TAHVFSCLSLRLRAAFFY

SEQ ID NO: 171 - protein, 19 aa, Artificial Sequence
  Description of Artificial Sequence: Synthetic peptide
NPFIYSRNSAGLRRKVLWC

SEQ ID NO: 172 - protein, 20 aa, Artificial Sequence
  Description of Artificial Sequence: Synthetic peptide
NNESSNNPSSIASFLSSITY

SEQ ID NO: 173 - protein, 20 aa, Artificial Sequence
  Description of Artificial Sequence: Synthetic peptide
TPQLFINYKLKSVAHLPWRM

SEQ ID NO: 174 - protein, 20 aa, Artificial Sequence
  Description of Artificial Sequence: Synthetic peptide
WRLKPSADCGPFRGLPLFIH

SEQ ID NO: 175 - protein, 21 aa, Artificial Sequence
  Description of Artificial Sequence: Synthetic peptide
NIPLLFYHLWRYFHRPADGSE

SEQ ID NO: 176 - protein, 21 aa, Artificial Sequence
  Description of Artificial Sequence: Synthetic peptide
SQVTKSSPEQSYQGDMYPTRG

SEQ ID NO: 177 - protein, 21 aa, Artificial Sequence
  Description of Artificial Sequence: Synthetic peptide
CCSALQKRCRKCFNKDSTEAT

SEQ ID NO: 178 - protein, 21 aa, Artificial Sequence
  Description of Artificial Sequence: Synthetic peptide
CQRLAARLGVVTGKDLGEVCH

SEQ ID NO: 179 - protein, 21 aa, Artificial Sequence
  Description of Artificial Sequence: Synthetic peptide
QVFRNISGKQSSLPAMSKVRR

SEQ ID NO: 180 - protein, 22 aa, Artificial Sequence
  Description of Artificial Sequence: Synthetic peptide
GGRREGESWNWAWVLSTRLARH

SEQ ID NO: 181 - protein, 22 aa, Artificial Sequence
  Description of Artificial Sequence: Synthetic peptide
YKMYGSEMLHKRDPLDEDEDTD

SEQ ID NO: 182 - protein, 23 aa, Artificial Sequence
  Description of Artificial Sequence: Synthetic peptide
HMYRERGGELLVHTGFLGSSQDR

SEQ ID NO: 183 - protein, 23 aa, Artificial Sequence
  Description of Artificial Sequence: Synthetic peptide
RKWCQYQKEIMERPPPFKPPPPP

SEQ ID NO: 184 - protein, 23 aa, Artificial Sequence
  Description of Artificial Sequence: Synthetic peptide
HNKRKIFLLVQSRKWRDGLCSKT

SEQ ID NO: 185 - protein, 23 aa, Artificial Sequence
  Description of Artificial Sequence: Synthetic peptide
RAARRRPEHLDTPDTPPRSQAQE

SEQ ID NO: 186 - protein, 23 aa, Artificial Sequence
  Description of Artificial Sequence: Synthetic peptide
NGTCFTAGRLIYVAGREGHMLKV

SEQ ID NO: 187 - protein, 24 aa, Artificial Sequence
  Description of Artificial Sequence: Synthetic peptide
DANYEMPGETLKVRYWPRDSWPVG

SEQ ID NO: 188 - protein, 15 aa, Artificial Sequence
  Description of Artificial Sequence: Synthetic peptide
ARSQMARNIWYFVVS

SEQ ID NO: 189 - protein, 24 aa, Artificial Sequence
  Description of Artificial Sequence: Synthetic peptide
LRKRRDSLSLSTQRTQGPAESARN

SEQ ID NO: 190 - protein, 25 aa, Artificial Sequence
  Description of Artificial Sequence: Synthetic peptide
DAASEIPEQGPVIKFWPNEKWAFIG

SEQ ID NO: 191 - protein, 25 aa, Artificial Sequence
  Description of Artificial Sequence: Synthetic peptide
WGYKNYREQRQLPQGDYVKKPGDGD

SEQ ID NO: 192 - protein, 23 aa, Artificial Sequence
  Description of Artificial Sequence: Synthetic peptide
TSYYSFVSHLRKIRTCTSIMEKD

SEQ ID NO: 193 - protein, 19 aa, Artificial Sequence
  Description of Artificial Sequence: Synthetic peptide
LIVRALIYKDLDNSPLRRK

SEQ ID NO: 194 - protein, 24 aa, Artificial Sequence
  Description of Artificial Sequence: Synthetic peptide
DHWALTQRTARAVSPQSTKPMAES

SEQ ID NO: 195 - protein, 25 aa, Artificial Sequence
  Description of Artificial Sequence: Synthetic peptide
HHNKRKIIAFVLEGKRSKVTRRPKA

SEQ ID NO: 196 - protein, 26 aa, Artificial Sequence
  Description of Artificial Sequence: Synthetic peptide
EWKSPFGLTPKGRNRSKVFSFSSALN

SEQ ID NO: 197 - protein, 27 aa, Artificial Sequence
  Description of Artificial Sequence: Synthetic peptide
YFLGRLVPRGRGAAEAATRKQRITETE

SEQ ID NO: 198 - protein, 28 aa, Artificial Sequence
  Description of Artificial Sequence: Synthetic peptide
QATACRTCHRQQQPAACRGFARVARTIL

SEQ ID NO: 199 - protein, 28 aa, Artificial Sequence
  Description of Artificial Sequence: Synthetic peptide
NKFSKYYQKQKDIDVDQCSEDAPEKCHE

SEQ ID NO: 200 - protein, 28 aa, Artificial Sequence
  Description of Artificial Sequence: Synthetic peptide
SKCSREVLWHCHLCPSSTEHASASANGH

SEQ ID NO: 201 - protein, 28 aa, Artificial Sequence
  Description of Artificial Sequence: Synthetic peptide
DMGSSDGETTHDSQITQEAVPKSLGASE

SEQ ID NO: 202 - protein, 29 aa, Artificial Sequence
  Description of Artificial Sequence: Synthetic peptide
CSRAARGTIGARRTGQPLKEDPSAVPVFS

SEQ ID NO: 203 - protein, 30 aa, Artificial Sequence
  Description of Artificial Sequence: Synthetic polypeptide
SVQKLSEFLSSAEIREEQCAPHEPTPQGPA

SEQ ID NO: 204 - protein, 30 aa, Artificial Sequence
  Description of Artificial Sequence: Synthetic polypeptide
KCYKIEIMLFYRNHFGAEELDGDNKDYDAY

SEQ ID NO: 205 - protein, 30 aa, Artificial Sequence
  Description of Artificial Sequence: Synthetic polypeptide
KCYNIELMLFYRQHFGADETNDDNKEYDAY

SEQ ID NO: 206 - protein, 30 aa, Artificial Sequence
  Description of Artificial Sequence: Synthetic polypeptide
GWKLRSYKTLFDAAETMVSLQLGIFNYEEV

SEQ ID NO: 207 - protein, 30 aa, Artificial Sequence
  Description of Artificial Sequence: Synthetic polypeptide
SSFSSCKDVTAEENNEAKNLQLAVARIKKG

SEQ ID NO: 208 - protein, 30 aa, Artificial Sequence
  Description of Artificial Sequence: Synthetic polypeptide
MRTKAAGCAERRPLQPRTEAAAAPAGRAMP

SEQ ID NO: 209 - protein, 31 aa, Artificial Sequence
  Description of Artificial Sequence: Synthetic polypeptide
RKRWQNEKLGLDAGDEYEDENLYEGLNLDDC

SEQ ID NO: 210 - protein, 31 aa, Artificial Sequence
  Description of Artificial Sequence: Synthetic polypeptide
MASHEVDNAELGSASAHGTPGSEAGPEELNT

SEQ ID NO: 211 - protein, 31 aa, Artificial Sequence
  Description of Artificial Sequence: Synthetic polypeptide
NGHPTSNAALFFIERRPHHWPAMKFRSHPDH

SEQ ID NO: 212 - protein, 32 aa, Artificial Sequence
  Description of Artificial Sequence: Synthetic polypeptide
ALLNNIIEIRLDAKKFVTELRRPVAVRAKDIG

SEQ ID NO: 213 - protein, 32 aa, Artificial Sequence
  Description of Artificial Sequence: Synthetic polypeptide
PETKGQSLAEIDQQFQKRRFTLSFGHRQNSTG

SEQ ID NO: 214 - protein, 32 aa, Artificial Sequence
  Description of Artificial Sequence: Synthetic polypeptide
PETKGKKLEEIESLFDNRLCTCGTSDSDEGRY

SEQ ID NO: 215 - protein, 32 aa, Artificial Sequence
  Description of Artificial Sequence: Synthetic polypeptide
YNLMSQKFRAAFRKLCNCKQKPTEKPANYSVA

SEQ ID NO: 216 - protein, 33 aa, Artificial Sequence
  Description of Artificial Sequence: Synthetic polypeptide
NYIFFGRGPQRQKKAAEKAASANNEKMRLDVNK

SEQ ID NO: 217 - protein, 33 aa, Artificial Sequence
  Description of Artificial Sequence: Synthetic polypeptide
DLNESANSTAQYASNAWFAAASSEPEEGISVFE

SEQ ID NO: 218 - protein, 33 aa, Artificial Sequence; identical to SEQ ID NO: 217
  Description of Artificial Sequence: Synthetic polypeptide

SEQ ID NO: 219 - protein, 34 aa, Artificial Sequence
  Description of Artificial Sequence: Synthetic polypeptide
SYQQKKFCFSIQQGLNADYVKGENLEAVVCEEPQ

SEQ ID NO: 220 - protein, 34 aa, Artificial Sequence
  Description of Artificial Sequence: Synthetic polypeptide
MDGSGERSLPEPGSQSSAASDDIEIVVNVGGVRQ

SEQ ID NO: 221 - protein, 34 aa, Artificial Sequence
  Description of Artificial Sequence: Synthetic polypeptide
RWCSKKKDAAVMNQEPAGHRTVNREDSDEQDPQE

SEQ ID NO: 222 - protein, 35 aa, Artificial Sequence
  Description of Artificial Sequence: Synthetic polypeptide
MFCSEKKLREVERIVKANDREYNEKFQYADNRIHT

SEQ ID NO: 223 - protein, 35 aa, Artificial Sequence
  Description of Artificial Sequence: Synthetic polypeptide
TQFSETKQRESQLMREQRVRFLSNASTLASFSEPG

SEQ ID NO: 224 - protein, 35 aa, Artificial Sequence
  Description of Artificial Sequence: Synthetic polypeptide
NWLNPPRLQMGSMTSTTLYNSMWFVYGSFVQQGGE

SEQ ID NO: 225 - protein, 35 aa, Artificial Sequence
  Description of Artificial Sequence: Synthetic polypeptide
CFYIKKINPLKEKSIILPKSLISVVRSATLETKPE

SEQ ID NO: 226 - protein, 35 aa, Artificial Sequence
  Description of Artificial Sequence: Synthetic polypeptide
HRWCANKKNAVVMDQEPAGNRTVNREDSDEQDPQE

SEQ ID NO: 227 - protein, 36 aa, Artificial Sequence
  Description of Artificial Sequence: Synthetic polypeptide
NYYSSCRKPTTTKKTTSLLHPDSSRWIPERISLQAP

SEQ ID NO: 228 - protein, 36 aa, Artificial Sequence
  Description of Artificial Sequence: Synthetic polypeptide
HLTALFLTVYEWRSPYGLTPRGRNRSTVFSYSSALN

SEQ ID NO: 229 - protein, 36 aa, Artificial Sequence
  Description of Artificial Sequence: Synthetic polypeptide
YFFIRTLQAHHDRSERESPFSGSSRQPDSLSSIENA

SEQ ID NO: 230 - protein, 36 aa, Artificial Sequence
  Description of Artificial Sequence: Synthetic polypeptide
LHCCCSNKKNAAVMDQEPAGDRTVNREDSDDQDPQE

SEQ ID NO: 231 - protein, 36 aa, Artificial Sequence
  Description of Artificial Sequence: Synthetic polypeptide
HYLRFQRKSIDGSFGSNDGSGNMVASHPIAASTPEG

SEQ ID NO: 232 - protein, 37 aa, Artificial Sequence
  Description of Artificial Sequence: Synthetic polypeptide
RWWNQYENLPWPDRLMSLVSGFVEGKDEQGRLLRRTL

SEQ ID NO: 233 - protein, 37 aa, Artificial Sequence
  Description of Artificial Sequence: Synthetic polypeptide
DVDVDDTTEEQGYGMAYTVHKWSELSWASHWVTFGCW

SEQ ID NO: 234 - protein, 38 aa, Artificial Sequence
  Description of Artificial Sequence: Synthetic polypeptide
RYCWLRRQAALQRRLSAMEKGKLHKPGKDASKRGRQTP

SEQ ID NO: 235 - protein, 38 aa, Artificial Sequence
  Description of Artificial Sequence: Synthetic polypeptide
MKKAEMGRFSISPDEDSSSYSSNSDFNYSYPTKQAALK

SEQ ID NO: 236 - protein, 39 aa, Artificial Sequence
  Description of Artificial Sequence: Synthetic polypeptide
LKCLIVALPKIILAVKSKGKFYLVIEELSQLFRSLVPIQ

SEQ ID NO: 237 - protein, 39 aa, Artificial Sequence
  Description of Artificial Sequence: Synthetic polypeptide
ETLLNAPRAMGTSSSPPSPASVVAPGTTLFEESRLPVFT

SEQ ID NO: 238 - protein, 40 aa, Artificial Sequence
  Description of Artificial Sequence: Synthetic polypeptide
YVRSWRKAGPLPSQIPPTAPGGEQCPLYANVHHQKGKDEG

SEQ ID NO: 239 - protein, 40 aa, Artificial Sequence
  Description of Artificial Sequence: Synthetic polypeptide
TYLSEPLVRGYTTAAAVQVFVSQLKYVFGLHLSSHSGPLS

SEQ ID NO: 240 - protein, 37 aa, Artificial Sequence
  Description of Artificial Sequence: Synthetic polypeptide
RWWSQYTSIPLPDQLMCVISASVHGVDQRGRLLRRTL

SEQ ID NO: 241 - protein, 41 aa, Artificial Sequence
  Description of Artificial Sequence: Synthetic polypeptide
RRFRQACLETCARCCPRPPRARPRALPDEDPPTPSIASLSR

SEQ ID NO: 242 - protein, 36 aa, Artificial Sequence
  Description of Artificial Sequence: Synthetic polypeptide
MAEAITYADLRFVKAPLKKSISSRLGQDPGADDDGE

SEQ ID NO: 243 - protein, 41 aa, Artificial Sequence
  Description of Artificial Sequence: Synthetic polypeptide
MQTSEREGSGPELSPSVMPEAPLESPPFPTKSPAFDLFNLV

SEQ ID NO: 244 - protein, 42 aa, Artificial Sequence
  Description of Artificial Sequence: Synthetic polypeptide
SKEKQFRGLQSRIEQEQKFTVIRGGQVIQIPVADITVGDIAQ

SEQ ID NO: 245 - protein, 42 aa, Artificial Sequence
  Description of Artificial Sequence: Synthetic polypeptide
SKEKQFRGLQSRIEQEQKFTVVRAGQVVQIPVAEIVVGDIAQ

SEQ ID NO: 246 - protein, 42 aa, Artificial Sequence
  Description of Artificial Sequence: Synthetic polypeptide
SKEKQFRGLQCRIEQEQKFSIIRNGQLIQLPVAEIVVGDIAQ

SEQ ID NO: 247 - protein, 42 aa, Artificial Sequence
  Description of Artificial Sequence: Synthetic polypeptide
KCLQGNADGDGGGGQCCRRQDSPSPDFYKQSSPNLQVSSDGT

SEQ ID NO: 248 - protein, 43 aa, Artificial Sequence
  Description of Artificial Sequence: Synthetic polypeptide
SSECQRYVYSILCCKESSDPSSYNSSGQLMASKMDTCSSNLNN

SEQ ID NO: 249 - protein, 37 aa, Artificial Sequence
  Description of Artificial Sequence: Synthetic polypeptide
MDNQGVIYSDLNLPPNPKRQQRKPKGNKNSILATEQE

SEQ ID NO: 250 - protein, 43 aa, Artificial Sequence
  Description of Artificial Sequence: Synthetic polypeptide
WWGDIWWKTMMELRSLDTQKATCHLQQVTDLPWTSVSSPVERE

SEQ ID NO: 251 - protein, 43 aa, Artificial Sequence
  Description of Artificial Sequence: Synthetic polypeptide
RLLFSKTYKLQERSDLTVKEKEELIEEWQPEPLVPPVPKDHPA

SEQ ID NO: 252 - protein, 44 aa, Artificial Sequence
  Description of Artificial Sequence: Synthetic polypeptide
KYYPINMDFKPNFITTYKCECVAPDTVNTTVFNASAPLAPDTNA

SEQ ID NO: 253 - protein, 44 aa, Artificial Sequence
  Description of Artificial Sequence: Synthetic polypeptide
CIRRSCLHRRRTFTYQSGSGEETILQFSSGTLTLTRRPKLQPEP

SEQ ID NO: 254 - protein, 45 aa, Artificial Sequence
  Description of Artificial Sequence: Synthetic polypeptide
MTNPSDRVLPANSMAESREGDFGCTVMELRKLMELRSRDALTQIN

SEQ ID NO: 255 - protein, 45 aa, Artificial Sequence; identical to SEQ ID NO: 10
  Description of Artificial Sequence: Synthetic polypeptide

SEQ ID NO: 256 - protein, 45 aa, Artificial Sequence
  Description of Artificial Sequence: Synthetic polypeptide
WCQCCPHTCCCYVRCPCCPDKCCCPEALYAAGKAATSGVPSIYAP

SEQ ID NO: 257 - protein, 45 aa, Artificial Sequence
  Description of Artificial Sequence: Synthetic polypeptide
AVCQCRRKNYGQLDIFPARDTYHPMSEYPTYHTHGRYVPPSSTDR

SEQ ID NO: 258 - protein, 46 aa, Artificial Sequence
  Description of Artificial Sequence: Synthetic polypeptide
TVVLRVQFPSWNGLGSIPSTDIYKSTKNYKNIEEPQGVKILRFSSP

SEQ ID NO: 259 - protein, 47 aa, Artificial Sequence
  Description of Artificial Sequence: Synthetic polypeptide
DNTVPGSPEERGLIQWKAGAHANSDMSSSLKSYDFPIGMGIVKRITF

SEQ ID NO: 260 - protein, 47 aa, Artificial Sequence
  Description of Artificial Sequence: Synthetic polypeptide
YRCSQHSSSSEESTKRTSHSKLPEQEAAEADLSNMERVSLSTADPQG

SEQ ID NO: 261 - protein, 48 aa, Artificial Sequence
  Description of Artificial Sequence: Synthetic polypeptide
GLKGIRSALKRPVEQPLGEIPEKSLHSIAVSSIQKAKGYQLLEEEKIV

SEQ ID NO: 262 - protein, 48 aa, Artificial Sequence
  Description of Artificial Sequence: Synthetic polypeptide
RWRRRKGQQRTKATTPAREPFQNTEEPYENIRNEGQNTDPKLNPKDDG

SEQ ID NO: 263 - protein, 49 aa, Artificial Sequence
  Description of Artificial Sequence: Synthetic polypeptide
RFTGHPGAYLRLINRWRLEECHPSGCLIDLCMQMGIIMVLKQTWNNFME

SEQ ID NO: 264 - protein, 49 aa, Artificial Sequence
  Description of Artificial Sequence: Synthetic polypeptide
VVALIYCRKKRISALPGYPECREMGETLPEKPANPTNPDEADKVGAENT

SEQ ID NO: 265 - protein, 49 aa, Artificial Sequence
  Description of Artificial Sequence: Synthetic polypeptide
SYRYVTKPPAPPNSLNVQRVLTFQPLRFIQEHVLIPVFDLSGPSSLAQP

SEQ ID NO: 266 - protein, 49 aa, Artificial Sequence; identical to SEQ ID NO: 11
  Description of Artificial Sequence: Synthetic polypeptide

SEQ ID NO: 267 - protein, 49 aa, Artificial Sequence
  Description of Artificial Sequence: Synthetic polypeptide
TLRNATQQKDMVEVADFDFSPMSDKNPEPPSGVRCCCQMCCGPFLLETP

SEQ ID NO: 268 - protein, 62 aa, Artificial Sequence
  Description of Artificial Sequence: Synthetic polypeptide
HRQNQIKQGPPRSKDEEQKPQQRPDLAVDVLERTADKATVNGLPEKDRETDTSALAAGSSQE

SEQ ID NO: 269 - protein, 50 aa, Artificial Sequence
  Description of Artificial Sequence: Synthetic polypeptide
MDEEEDGAGAEESGQPRSFMRLNDLSGAGGRPGPGSAEKDPGSADSEAEG

SEQ ID NO: 270 - protein, 50 aa, Artificial Sequence
  Description of Artificial Sequence: Synthetic polypeptide
EMLHLGFGTIRDSLNSKRRELEDPGAYNYPFTWNTPSAPPGYNIAVKPDQ

SEQ ID NO: 271 - protein, 51 aa, Artificial Sequence
  Description of Artificial Sequence: Synthetic polypeptide
AKTGRTSIQRDLKEQQPQALAPGRGPSHSSAFSMSPLSTAQAPLPNPRTAA

SEQ ID NO: 272 - protein, 51 aa, Artificial Sequence
  Description of Artificial Sequence: Synthetic polypeptide
LCLRKQSNGREAEYSDKHGQYLIGHGTKVYIDPFTYEDPNEAVREFAKEID

SEQ ID NO: 273 - protein, 51 aa, Artificial Sequence
  Description of Artificial Sequence: Synthetic polypeptide
KNFRRDFFILLSKCGCYEMQAQIYRTETSSTVHNTHPRNGHCSSAPRVTNG

SEQ ID NO: 274 - protein, 51 aa, Artificial Sequence
  Description of Artificial Sequence: Synthetic polypeptide
QDIGYFLKVAAVGRRVRSYGKRRPARTILRAFLEKARQTPHKPFLLFRDET

SEQ ID NO: 275 - protein, 54 aa, Artificial Sequence
  Description of Artificial Sequence: Synthetic polypeptide
MSAARPQFSIDDAFELSLEDGGPGPESSGVARFGPLHFERRARFEVADEDKQSR

SEQ ID NO: 276 - protein, 55 aa, Artificial Sequence
  Description of Artificial Sequence: Synthetic polypeptide
YAATSRQLKRLESVSRSPIYSHFSETVTGASVIRAYNRSRDFEIISDTKVDANQR

SEQ ID NO: 277 - protein, 55 aa, Artificial Sequence
  Description of Artificial Sequence: Synthetic polypeptide
MTVPKEMPEKWARAQAPPSWSRKKPSWGTEEERRARANDREYNEKFQYASNCIKT

SEQ ID NO: 278 - protein, 55 aa, Artificial Sequence; identical to SEQ ID NO: 12
  Description of Artificial Sequence: Synthetic polypeptide

SEQ ID NO: 279 - protein, 55 aa, Artificial Sequence; identical to SEQ ID NO: 14
  Description of Artificial Sequence: Synthetic polypeptide

SEQ ID NO: 280 - protein, 55 aa, Artificial Sequence; identical to SEQ ID NO: 13
  Description of Artificial Sequence: Synthetic polypeptide

SEQ ID NO: 281 - protein, 56 aa, Artificial Sequence
  Description of Artificial Sequence: Synthetic polypeptide
MKFEEKCGDNGSIVGRNQSYPGEKHQPKGKPIANGEAEVYAKQEANGKCSTPRKSL

SEQ ID NO: 282 - protein, 56 aa, Artificial Sequence
  Description of Artificial Sequence: Synthetic polypeptide
DIKINQYIIKKCSPCCACLAKAMERSEQQPLMGWEDEGQPFIRRQSRTDSGIFYED

SEQ ID NO: 283 - protein, 56 aa, Artificial Sequence
  Description of Artificial Sequence: Synthetic polypeptide
MAEPQAESEPLLGGARGGGGDWPAGLTTYRSIQVGPGAAARWDLCIDQAVVFIEDA

SEQ ID NO: 284 - protein, 57 aa, Artificial Sequence
  Description of Artificial Sequence: Synthetic polypeptide
AVTISLAYSVKKMMKDNNLVRHLDACETMGNATAICSDKTGTLTTNRMTVVQAYVGD

SEQ ID NO: 285 - protein, 57 aa, Artificial Sequence
  Description of Artificial Sequence: Synthetic polypeptide
AVTISLAYSVKKMMKDNNLVRHLDACETMGNATAICSDKTGTLTMNRMTVVQAYIGG

SEQ ID NO: 286 - protein, 57 aa, Artificial Sequence
  Description of Artificial Sequence: Synthetic polypeptide
SNMKSRSAGKLWELQHEIEVYRKTVIAQWRALDLDVVLTPMLAPALDLNAPGRATGA

SEQ ID NO: 287 - protein, 57 aa, Artificial Sequence
  Description of Artificial Sequence: Synthetic polypeptide
HPELNVQKRKRSFKAVVTAATMSSRLSHKPSDRPNGEAKTELCENVDPNSPAAKKKY

SEQ ID NO: 288 - protein, 57 aa, Artificial Sequence
  Description of Artificial Sequence: Synthetic polypeptide
RKSNFIFDKLHKVGIKTRRQWRRSQFCDINILAMFCNENRDHIKSLNRLDFITNESD

SEQ ID NO: 289 - protein, 57 aa, Artificial Sequence; identical to SEQ ID NO: 15
  Description of Artificial Sequence: Synthetic polypeptide

SEQ ID NO: 290 - protein, 58 aa, Artificial Sequence
  Description of Artificial Sequence: Synthetic polypeptide
SGKTLESWRSLCTRCCWASKGAAVGGGAGATAAGGGGGPGGGGGGGPGGGGGPGGGGG

SEQ ID NO: 291 - protein, 58 aa, Artificial Sequence
  Description of Artificial Sequence: Synthetic polypeptide
RSCRKKSARPAADVGDIGMKDANTIRGSASQGNLTESWADDNPRHHGLAAHSSGEERE

SEQ ID NO: 292 - protein, 58 aa, Artificial Sequence
  Description of Artificial Sequence: Synthetic polypeptide
MKSKMRQALGFAKEARESPDTQALLTCAEKEEENQENLDWVPLTTLSHCKSLRTMTAI

SEQ ID NO: 293 - protein, 58 aa, Artificial Sequence
  Description of Artificial Sequence: Synthetic polypeptide
AILFAVVARGTTILAKHAWCGGNFLEVTEQILAKIPSENNKLTYSHGNYLFHYICQDR

SEQ ID NO: 294 - protein, 59 aa, Artificial Sequence
  Description of Artificial Sequence: Synthetic polypeptide
MDHAEENEILAATQRYYVERPIFSHPVLQERLHTKDKVPDSIADKLKQAFTCTPKKIRN

SEQ ID NO: 295 - protein, 60 aa, Artificial Sequence
  Description of Artificial Sequence: Synthetic polypeptide
KKLVKKFRQKKQRQWIGPTGMNQNMSFHRNHTATVRSHAENPTASHVDNEYSQPPRNSHL

SEQ ID NO: 296 - protein, 60 aa, Artificial Sequence
  Description of Artificial Sequence: Synthetic polypeptide
MPRRLQPRGAGTKGPPAPAPAASGAARNSHSAASRDPPASAKPLLRWDEVPDDFVECFIL

SEQ ID NO: 297 - protein, 60 aa, Artificial Sequence
  Description of Artificial Sequence: Synthetic polypeptide
RSCRKKSARPAVGVGDTGMEDANAVRGSASQGPLIESPADDSPPHHAPPALATPSPEEGE

SEQ ID NO: 298 - protein, 61 aa, Artificial Sequence
  Description of Artificial Sequence: Synthetic polypeptide
DNFEYLTRDSSILGPHHLDEFIRVWAEYDPAACGRISYNDMFEMLKHMSPPLGLGKKCPAR

SEQ ID NO: 299 - protein, 61 aa, Artificial Sequence
  Description of Artificial Sequence: Synthetic polypeptide
SKRWTHLPCGCIINCRQNAYAVASDGKKIKRKGFEFNLSFQKSYGIYKIAHEDYYDDDENS

SEQ ID NO: 300 - protein, 45 aa, Artificial Sequence
  Description of Artificial Sequence: Synthetic polypeptide
NFNYFYHRETEGEEQSQYMHVGSCQHLSSSAEELRKARSNSTLSK

SEQ ID NO: 301 - protein, 61 aa, Artificial Sequence; identical to SEQ ID NO: 17
  Description of Artificial Sequence: Synthetic polypeptide

SEQ ID NO: 302 - protein, 63 aa, Artificial Sequence
  Description of Artificial Sequence: Synthetic polypeptide
LKLANEETIKNITHWTLFNYYNSSGWNESVPRPPLHPADVPRGSCWETAVGIEFMRLTVSDML

SEQ ID NO: 303 - protein, 64 aa, Artificial Sequence
  Description of Artificial Sequence: Synthetic polypeptide
MCHSRSCHPTMTILQAPTPAPSTIPGPRRGSGPEIFTFDPLPEPAAAPAGRPSASRGHRKRSRR

SEQ ID NO: 304 - protein, 64 aa, Artificial Sequence
  Description of Artificial Sequence: Synthetic polypeptide
ASSAASSEHFEKLHEIFRGLHEDLQGVPERLLGTAGTEEKKKLIRDFDEKQQEANETLAEMEEE

SEQ ID NO: 305 - protein, 66 aa, Artificial Sequence
  Description of Artificial Sequence: Synthetic polypeptide
MADQIPLYPVRSAAAAAANRKRAAYYSAAGPRPGADRHSRYQLEDESAHLDEMPLMMSEEGFENEE

SEQ ID NO: 306 - protein, 66 aa, Artificial Sequence
  Description of Artificial Sequence: Synthetic polypeptide
SMILSASVIRVRDGLPLSASTDYEQSTGMQECRKYFKMLSRKLAQLPDRCTLKTGHYNINFISSLG

SEQ ID NO: 307 - protein, 66 aa, Artificial Sequence
  Description of Artificial Sequence: Synthetic polypeptide
LTRKKKALRIHSVEGDLRRKSAGQEEWSPSAPSPPGSCVQAEAAPAGLCGEQRGEDCAELHDYFNV

SEQ ID NO: 308 - protein, 67 aa, Artificial Sequence
  Description of Artificial Sequence: Synthetic polypeptide
TIPTSRLKFLKEAGRLTQKEEIPEEELNEDVEEIDHAERELRRGQILWFRGLNRIQTQIRVVKAFRS

SEQ ID NO: 309 - protein, 67 aa, Artificial Sequence
  Description of Artificial Sequence: Synthetic polypeptide
TIPTSQLKCLKEAGHGPGKDEMTDEELAEGEEEIDHAERELRRGQILWFRGLNRIQTQIRVVKAFRS

SEQ ID NO: 310 - protein, 67 aa, Artificial Sequence; identical to SEQ ID NO: 18
  Description of Artificial Sequence: Synthetic polypeptide

SEQ ID NO: 311 - protein, 67 aa, Artificial Sequence
  Description of Artificial Sequence: Synthetic polypeptide
MGDTHWRVAQERDELWRAQVVATTVMLERKLPRCLWPRSGICGCEFGLGDRWFLRVENHNDQNPLRV

SEQ ID NO: 312 - protein, 68 aa, Artificial Sequence
  Description of Artificial Sequence: Synthetic polypeptide
YSPGDYICKKGDIGREMYIIKEGKLAVVADDGVTQFVVLSDGSYFGEISILNIKGSKAGNRRTANIKS

SEQ ID NO: 313 - protein, 68 aa, Artificial Sequence
  Description of Artificial Sequence: Synthetic polypeptide
FSPGDYICRKGDIGKEMYIIKEGKLAVVADDGVTQYALLSAGSCFGEISILNIKGSKMGNRRTANIRS

SEQ ID NO: 314 - protein, 68 aa, Artificial Sequence
  Description of Artificial Sequence: Synthetic polypeptide
CLKIIKEYERAVVFRLGRIQADKAKGPGLILVLPCIDVFVKVDLRTVTCNIPPQEILTRDSVTTQVDG

SEQ ID NO: 315 - protein, 69 aa, Artificial Sequence
  Description of Artificial Sequence: Synthetic polypeptide
MTEGARAADEVRVPLGAPPPGPAALVGASPESPGAPGREAERGSELGVSPSESPAAERGAELGADEEQR

SEQ ID NO: 316 - protein, 70 aa, Artificial Sequence; identical to SEQ ID NO: 19
  Description of Artificial Sequence: Synthetic polypeptide

SEQ ID NO: 317 - protein, 73 aa, Artificial Sequence
  Description of Artificial Sequence: Synthetic polypeptide
VITTCLALGTRRMAKKNAIVRSLPSVETLGCTSVICSDKTGTLTTNQMSVCRMFILDRVEGDTCSLNEFTITG

SEQ ID NO: 318 - protein, 73 aa, Artificial Sequence
  Description of Artificial Sequence: Synthetic polypeptide
MEAVLNELVSVEDLLKFEKKFQSEKAAGSVSKSTQFEYAWCLVRSKYNDDIRKGIVLLEELLPKGSKEEQRDY

SEQ ID NO: 319 - protein, 75 aa, Artificial Sequence
  Description of Artificial Sequence: Synthetic polypeptide
TRPKPLKPPCDLSMQSVEVAGSGGARRSALLDSDEPLVYFYDDVTTLYEGFQRGIQVSNNGPCLGSRKPDQPYEW

SEQ ID NO: 320 - protein, 75 aa, Artificial Sequence
  Description of Artificial Sequence: Synthetic polypeptide
HRPKALQPPCNLLMQSEEVEDSGGARRSVIGSGPQLLTHYYDDARTMYQVFRRGLSISGNGPCLGFRKPKQPYQW

SEQ ID NO: 321 - protein, 76 aa, Artificial Sequence; identical to SEQ ID NO: 20
  Description of Artificial Sequence: Synthetic polypeptide

SEQ ID NO: 322 - protein, 76 aa, Artificial Sequence
  Description of Artificial Sequence: Synthetic polypeptide
WSCERYRADVRTVWEQCVAIMSEEDGDDDGGCDDYAEGRVCKVRFDANGATGPGSRDPAQVKLLPGRHMLFPPLER

SEQ ID NO: 323 - protein, 73 aa, Artificial Sequence
  Description of Artificial Sequence: Synthetic polypeptide
GPLVRYLDVKKTNKKESINEELHIRLMDHLKAGIEDVCGHWSHYQVRDKFKKFDHRYLRKILIRKNLPKSSIV

SEQ ID NO: 324 - protein, 79 aa, Artificial Sequence
  Description of Artificial Sequence: Synthetic polypeptide
KYPTLLHQRKKQRFLSKHISHRGGAGENLENTMAAFQHAVKIGTDMLELDCHITKDEQVVVSHDENLKRATGVNVNISD

SEQ ID NO: 325 - protein, 79 aa, Artificial Sequence
  Description of Artificial Sequence: Synthetic polypeptide
AHDHYTVDVVVAYYITTRLFWWYHTMANQQVLKEASQMNLLARVWWYRPFQYFEKNVQGIVPRSYHWPFPWPVVHLSRQ

SEQ ID NO: 326 - protein, 79 aa, Artificial Sequence
  Description of Artificial Sequence: Synthetic polypeptide
SKASRAPRAHRDINVPRALVDILRHQAGPGTRPDRARSSSLTPGIGGPDSMPPRTPKNLYNTVKTPNLDWRALPPPSPS

SEQ ID NO: 327 - protein, 80 aa, Artificial Sequence
  Description of Artificial Sequence: Synthetic polypeptide
FKVYKWKQSRDLYRAPVSSLYRTPGPSLHADAVRGGLMSPHLYHQVYLTTDSRRSDPLLKKPGAASPLASRQNTLRSCDP

SEQ ID NO: 328 - protein, 81 aa, Artificial Sequence
  Description of Artificial Sequence: Synthetic polypeptide
MLCRKTSQQEHVYEAARAHAREANDSGETMRVAIFASGCSSDEPTSQNLGNNYSDEPCIGQEYQIIAQINGNYARLLDTVP

SEQ ID NO: 329 - protein, 82 aa, Artificial Sequence
  Description of Artificial Sequence: Synthetic polypeptide
KQKNEHHHGHSHYASESLPSKKDQEEGVMEKLQNGDLDHMIPQHCSSELDGKAPMVDEKVIVGSLSVQDLQASQSACYWLKG

SEQ ID NO: 330 - protein, 83 aa, Artificial Sequence
  Description of Artificial Sequence: Synthetic polypeptide
HKALMERALRATFREALSSLHSRRRLDTEKKHQEHLLLSILPAYLAREMKAEIMARLQAGQGSRPESTNNFHSLYVKRHQGVS

SEQ ID NO: 331 - protein, 83 aa, Artificial Sequence
  Description of Artificial Sequence: Synthetic polypeptide
HKHQMQDASRDLFTYTVKCIQIRRKLRIEKRQQENLLLSVLPAHISMGMKLAIIERLKEHGDRRCMPDNNFHSLYVKRHQNVS

SEQ ID NO: 332 - protein, 84 aa, Artificial Sequence
  Description of Artificial Sequence: Synthetic polypeptide
ERFVAKPCAIALNIQANGPQIAPPNAILEKVFTAITKHPDEKRLEGLSKQLDWDVRSIQRWFRQRRNQEKPSTLTRFCESMWRF

SEQ ID NO: 333 - protein, 84 aa, Artificial Sequence
  Description of Artificial Sequence: Synthetic polypeptide
AWRLWRCRVARSRELNKPWAAQDGPKPGLGLQPRYGSRSAPKPQVAVPSCPSTPDYENMFVGQPAAEHQWDEQGAHPSEDNDFY

SEQ ID NO: 334 - protein, 84 aa, Artificial Sequence
  Description of Artificial Sequence: Synthetic polypeptide
HLSQWTRGRSRSHPGQGRSGESVEEVPLYGNLHYLQTGRLSQDPEPDQQDPTLGGPARAAEEVMCYTSLQLRPPQGRIPGPGTP

SEQ ID NO: 335 - protein, 85 aa, Artificial Sequence
  Description of Artificial Sequence: Synthetic polypeptide
KKRHCGYSKAFQDSDEEKMHYQNGQAPPPVFLPLHHPPGKLPEPQFYAEPHTYEEPGRAGRSFTREIEASRIHIEKIIGSGDSGE

SEQ ID NO: 336 - protein, 85 aa, Artificial Sequence; identical to SEQ ID NO: 21
  Description of Artificial Sequence: Synthetic polypeptide

SEQ ID NO: 337 - protein, 86 aa, Artificial Sequence
  Description of Artificial Sequence: Synthetic polypeptide
MASPGAGRAPPELPERNCGYREVEYWDQRYQGAADSAPYDWFGDFSSFRALLEPELRPEDRILVLGCGNSALSYELFLGGFPNVTS

SEQ ID NO: 338 - protein, 86 aa, Artificial Sequence
  Description of Artificial Sequence: Synthetic polypeptide
MPHFTVVPVDGPRRGDYDNLEGLSWVDYGERAELDDSDGHGNHRESSPFLSPLEASRGIDYYDRNLALFEEELDIRPKVSSLLGKL

SEQ ID NO: 339 - protein, 89 aa, Artificial Sequence
  Description of Artificial Sequence: Synthetic polypeptide
AIPTRSLKFLKEAGHGTTKEEITKDAEGLDEIDHAEMELRRGQILWFRGLNRIQTQIDVINTFQTGASFKGVLRRQNMGQHLDVKLVPS

SEQ ID NO: 340 - protein, 89 aa, Artificial Sequence
  Description of Artificial Sequence: Synthetic polypeptide
IFMKTAQAHRRAETLIFSKHAVIALRHGRLCFMLRVGDLRKSMIISATIHMQVVRKTTSPEGEVVPLHQVDIPMENGVGGNSIFLVAPL

SEQ ID NO: 341 - protein, 89 aa, Artificial Sequence
  Description of Artificial Sequence: Synthetic polypeptide
SWKRYPASMKQLQQRSLMRRHRKKKRQSLKQMTPSTQEFYVDYKPTNTETSEMLLNGTGPCTYNKSGSRECEIPLSMNVSTFLAYDQPT

SEQ ID NO: 342 - protein, 91 aa, Artificial Sequence
  Description of Artificial Sequence: Synthetic polypeptide
MANVSKKVSWSGRDRDDEEAAPLLRRTARPGGGTPLLNGAGPGAARQSPRSALFRVGHMSSVELDDELLDPDMDPPHPFPKEIPHNEKLLS

SEQ ID NO: 343 - protein, 92 aa, Artificial Sequence
  Description of Artificial Sequence: Synthetic polypeptide
RLFKRRQGRIFPEGSCLNTFTKNPYAASKKTIYTYIMASRNTQPAESRIYDEILQSKVLPSKEEPVNTVYSEVQFADKMGKASTQDSKPPGT

SEQ ID NO: 344 - protein, 59 aa, Artificial Sequence
  Description of Artificial Sequence: Synthetic polypeptide
AMCLWKNRQQNTIQKYDPPGYLYQGSDMNGQMVDYTTLSGASQINGNVHGGFLTNGGLS

SEQ ID NO: 345 - protein, 92 aa, Artificial Sequence
  Description of Artificial Sequence: Synthetic polypeptide
LGSGFALKVQEQHRQKHFEKRRMPAANLIQAAWRLYSTDMSRAYLTATWYYYDSILPSFRELALLFEHVQRARNGGLRPLEVRRAPVPDGAP

SEQ ID NO: 346 - protein, 94 aa, Artificial Sequence
  Description of Artificial Sequence: Synthetic polypeptide
MSSHKGSVVAQGNGAPASNREADTVELAELGPLLEEKGKRVIANPPKAEEEQTCPVPQEEEEEVRVLTLPLQAHHAMEKMEEFVYKVWEGRWRV

SEQ ID NO: 347 - protein, 69 aa, Artificial Sequence
  Description of Artificial Sequence: Synthetic polypeptide
WRMMKYQQKAAGMSPEQVLQPLEGDLCYADLTLQLAGTSPQKATTKLSSAQVDQVEVEYVTMASLPKED

SEQ ID NO: 348 - protein, 95 aa, Artificial Sequence
  Description of Artificial Sequence: Synthetic polypeptide
HYARARRKPGGLSATGTSSHSPSECQEPSSSRPSRIDPQEPTHSKPLAPMELEPMYSNVNPGDSNPIYSQIWSIQHTKENSANCPMMHQEHEELT

SEQ ID NO: 349 - protein, 95 aa, Artificial Sequence
  Description of Artificial Sequence: Synthetic polypeptide
MAKRKQGNRLGVCGRFLSSRVSGMNPSSVVHHVSDSGPAAELPLDVPHIRLDSPPSFDNTTYTSLPLDSPSGKPSLPAPSSLPPLPPKVLVCSKP

SEQ ID NO: 350 - protein, 99 aa, Artificial Sequence
  Description of Artificial Sequence: Synthetic polypeptide
SPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQ

SEQ ID NO: 351 - protein, 156 aa, Artificial Sequence; identical to SEQ ID NO: 26
  Description of Artificial Sequence: Synthetic polypeptide

SEQ ID NO: 352 - protein, 4 aa, Artificial Sequence
  Description of Artificial Sequence: Synthetic peptide
QGVQ

SEQ ID NO: 353 - protein, 4 aa, Artificial Sequence
  Description of Artificial Sequence: Synthetic peptide
FSVR

SEQ ID NO: 354 - protein, 4 aa, Artificial Sequence
  Description of Artificial Sequence: Synthetic peptide
YSSK

SEQ ID NO: 355 - protein, 4 aa, Artificial Sequence
  Description of Artificial Sequence: Synthetic peptide
PKTR

SEQ ID NO: 356 - protein, 4 aa, Artificial Sequence
  Description of Artificial Sequence: Synthetic peptide
VNDT

SEQ ID NO: 357 - protein, 4 aa, Artificial Sequence
  Description of Artificial Sequence: Synthetic peptide
GMQQ

SEQ ID NO: 358 - protein, 4 aa, Artificial Sequence
  Description of Artificial Sequence: Synthetic peptide
PDLL

SEQ ID NO: 359 - protein, 4 aa, Artificial Sequence
  Description of Artificial Sequence: Synthetic peptide
HKSL

SEQ ID NO: 360 - protein, 5 aa, Artificial Sequence
  Description of Artificial Sequence: Synthetic peptide
RQPLN

SEQ ID NO: 361 - protein, 5 aa, Artificial Sequence
  Description of Artificial Sequence: Synthetic peptide
RTPTN

SEQ ID NO: 362 - protein, 5 aa, Artificial Sequence
  Description of Artificial Sequence: Synthetic peptide
RNLTN

SEQ ID NO: 363 - protein, 5 aa, Artificial Sequence
  Description of Artificial Sequence: Synthetic peptide
TVFSP

SEQ ID NO: 364 - protein, 5 aa, Artificial Sequence
  Description of Artificial Sequence: Synthetic peptide
NRFMK

SEQ ID NO: 365 - protein, 5 aa, Artificial Sequence
  Description of Artificial Sequence: Synthetic peptide
LNAIA

SEQ ID NO: 366 - protein, 5 aa, Artificial Sequence
  Description of Artificial Sequence: Synthetic peptide
LFTML

SEQ ID NO: 367 - protein, 5 aa, Artificial Sequence
  Description of Artificial Sequence: Synthetic peptide
MYVMG

SEQ ID NO: 368 - protein, 5 aa, Artificial Sequence
  Description of Artificial Sequence: Synthetic peptide
VTGTR

SEQ ID NO: 369 - protein, 5 aa, Artificial Sequence
  Description of Artificial Sequence: Synthetic peptide
TTHRR

SEQ ID NO: 370 - protein, 5 aa, Artificial Sequence
  Description of Artificial Sequence: Synthetic peptide
VTRRK

SEQ ID NO: 371 - protein, 5 aa, Artificial Sequence
  Description of Artificial Sequence: Synthetic peptide
VTPVR

SEQ ID NO: 372 - protein, 5 aa, Artificial Sequence
  Description of Artificial Sequence: Synthetic peptide
MTVRK

SEQ ID NO: 373 - protein, 5 aa, Artificial Sequence
  Description of Artificial Sequence: Synthetic peptide
MTVKR

SEQ ID NO: 374 - protein, 5 aa, Artificial Sequence
  Description of Artificial Sequence: Synthetic peptide
VTPRR

SEQ ID NO: 375 - protein, 5 aa, Artificial Sequence
  Description of Artificial Sequence: Synthetic peptide
KPWWD

SEQ ID NO: 376 - protein, 5 aa, Artificial Sequence
  Description of Artificial Sequence: Synthetic peptide
NRLMK

SEQ ID NO: 377 - protein, 5 aa, Artificial Sequence
  Description of Artificial Sequence: Synthetic peptide
FKETV

SEQ ID NO: 378 - protein, 6 aa, Artificial Sequence
  Description of Artificial Sequence: Synthetic peptide
PFLKNT

SEQ ID NO: 379 - protein, 6 aa, Artificial Sequence
  Description of Artificial Sequence: Synthetic peptide
VTQRRG

SEQ ID NO: 380 - protein, 6 aa, Artificial Sequence
  Description of Artificial Sequence: Synthetic peptide
MTERKA

SEQ ID NO: 381 - protein, 6 aa, Artificial Sequence
  Description of Artificial Sequence: Synthetic peptide
VTMRRT

SEQ ID NO: 382 - protein, 6 aa, Artificial Sequence
  Description of Artificial Sequence: Synthetic peptide
RQALAE

SEQ ID NO: 383 - protein, 6 aa, Artificial Sequence
  Description of Artificial Sequence: Synthetic peptide
APDSNT

SEQ ID NO: 384 - protein, 6 aa, Artificial Sequence
  Description of Artificial Sequence: Synthetic peptide
SKKRGG

SEQ ID NO: 385 - protein, 6 aa, Artificial Sequence
  Description of Artificial Sequence: Synthetic peptide
EISAAS

SEQ ID NO: 386 - protein, 6 aa, Artificial Sequence
  Description of Artificial Sequence: Synthetic peptide
STLGPG

SEQ ID NO: 387 - protein, 6 aa, Artificial Sequence
  Description of Artificial Sequence: Synthetic peptide
NSLSFL

SEQ ID NO: 388 - protein, 6 aa, Artificial Sequence
  Description of Artificial Sequence: Synthetic peptide
AHLVQY

SEQ ID NO: 389 - protein, 7 aa, Artificial Sequence
  Description of Artificial Sequence: Synthetic peptide
DEHDAII

SEQ ID NO: 390 - protein, 7 aa, Artificial Sequence
  Description of Artificial Sequence: Synthetic peptide
VTKRCAR

SEQ ID NO: 391 - protein, 7 aa, Artificial Sequence
  Description of Artificial Sequence: Synthetic peptide
KRIEHAK

SEQ ID NO: 392 - protein, 7 aa, Artificial Sequence
  Description of Artificial Sequence: Synthetic peptide
VTPWRLR

SEQ ID NO: 393 - protein, 7 aa, Artificial Sequence
  Description of Artificial Sequence: Synthetic peptide
VTPCRLR

SEQ ID NO: 394 - protein, 7 aa, Artificial Sequence
  Description of Artificial Sequence: Synthetic peptide
RWGFSKQ

SEQ ID NO: 395 - protein, 7 aa, Artificial Sequence
  Description of Artificial Sequence: Synthetic peptide
RGDDKDC

SEQ ID NO: 396 - protein, 7 aa, Artificial Sequence
  Description of Artificial Sequence: Synthetic peptide
ATRMMMG

SEQ ID NO: 397 - protein, 7 aa, Artificial Sequence
  Description of Artificial Sequence: Synthetic peptide
GPSRDPD

SEQ ID NO: 398 - protein, 8 aa, Artificial Sequence
  Description of Artificial Sequence: Synthetic peptide
VTLPRARR

SEQ ID NO: 399 - protein, 8 aa, Artificial Sequence
  Description of Artificial Sequence: Synthetic peptide
RLPYQLAQ

SEQ ID NO: 400 - protein, 8 aa, Artificial Sequence
  Description of Artificial Sequence: Synthetic peptide
LGSFLIGS

SEQ ID NO: 401 - protein, 8 aa, Artificial Sequence
  Description of Artificial Sequence: Synthetic peptide
MGDDSSNS

SEQ ID NO: 402 - protein, 8 aa, Artificial Sequence
  Description of Artificial Sequence: Synthetic peptide
PLSHLAQN

SEQ ID NO: 403 - protein, 8 aa, Artificial Sequence
  Description of Artificial Sequence: Synthetic peptide
ATEGKSVC

SEQ ID NO: 404 - protein, 9 aa, Artificial Sequence
  Description of Artificial Sequence: Synthetic peptide
HNNCEKDSV

SEQ ID NO: 405 - protein, 9 aa, Artificial Sequence
  Description of Artificial Sequence: Synthetic peptide
RTMKPLPRH

SEQ ID NO: 406 - protein, 9 aa, Artificial Sequence
  Description of Artificial Sequence: Synthetic peptide
SQRRNPWQA

SEQ ID NO: 407 - protein, 9 aa, Artificial Sequence
  Description of Artificial Sequence: Synthetic peptide
YPMKITGNR

SEQ ID NO: 408 - protein, 9 aa, Artificial Sequence
  Description of Artificial Sequence: Synthetic peptide
VSHLRSPRK

SEQ ID NO: 409 - protein, 9 aa, Artificial Sequence
  Description of Artificial Sequence: Synthetic peptide
SYPARTRKV

SEQ ID NO: 410 - protein, 9 aa, Artificial Sequence
  Description of Artificial Sequence: Synthetic peptide
WGRLRFARK

SEQ ID NO: 411 - protein, 9 aa, Artificial Sequence
  Description of Artificial Sequence: Synthetic peptide
VFLNKVMRG

SEQ ID NO: 412 - protein, 8 aa, Artificial Sequence
  Description of Artificial Sequence: Synthetic peptide
SGSGYQLV

SEQ ID NO: 413 - protein, 9 aa, Artificial Sequence
  Description of Artificial Sequence: Synthetic peptide
HSDSLGSAS

SEQ ID NO: 414 - protein, 9 aa, Artificial Sequence
  Description of Artificial Sequence: Synthetic peptide
KATVHLAYL

SEQ ID NO: 415 - protein, 10 aa, Artificial Sequence
  Description of Artificial Sequence: Synthetic peptide
CAEDYHWQWR

SEQ ID NO: 416 - protein, 10 aa, Artificial Sequence
  Description of Artificial Sequence: Synthetic peptide
QRLLVKAKTQ

SEQ ID NO: 417 - protein, 10 aa, Artificial Sequence
  Description of Artificial Sequence: Synthetic peptide
EDFLEESRNQ

SEQ ID NO: 418 - protein, 10 aa, Artificial Sequence
  Description of Artificial Sequence: Synthetic peptide
GEKAFGWPGK

SEQ ID NO: 419 - protein, 10 aa, Artificial Sequence
  Description of Artificial Sequence: Synthetic peptide
PTVSPFLRQR

SEQ ID NO: 420 - protein, 10 aa, Artificial Sequence
  Description of Artificial Sequence: Synthetic peptide
PRTVLWLTIE

SEQ ID NO: 421 - protein, 10 aa, Artificial Sequence
  Description of Artificial Sequence: Synthetic peptide
EVCWKLPQSK

SEQ ID NO: 422 - protein, 10 aa, Artificial Sequence
  Description of Artificial Sequence: Synthetic peptide
ISNRWLSIGV

SEQ ID NO: 423 - protein, 10 aa, Artificial Sequence
  Description of Artificial Sequence: Synthetic peptide
GNCSFFTETG

SEQ ID NO: 424 - protein, 10 aa, Artificial Sequence
  Description of Artificial Sequence: Synthetic peptide
DSIRGYFGET

SEQ ID NO: 425 - protein, 11 aa, Artificial Sequence
  Description of Artificial Sequence: Synthetic peptide
LHSNSFIRNNY

SEQ ID NO: 426 - protein, 11 aa, Artificial Sequence
  Description of Artificial Sequence: Synthetic peptide
TYYSETTVTRT

SEQ ID NO: 427 - protein, 11 aa, Artificial Sequence
  Description of Artificial Sequence: Synthetic peptide
TYYSRRTLLGV

SEQ ID NO: 428 - protein, 11 aa, Artificial Sequence
  Description of Artificial Sequence: Synthetic peptide
SSYFLGKLLSD

SEQ ID NO: 429 - protein, 11 aa, Artificial Sequence
  Description of Artificial Sequence: Synthetic peptide
QARLRQHYQTI

SEQ ID NO: 430 - protein, 12 aa, Artificial Sequence
  Description of Artificial Sequence: Synthetic peptide
LVFHHMAQHLMM

SEQ ID NO: 431 - protein, 12 aa, Artificial Sequence
  Description of Artificial Sequence: Synthetic peptide
YSTKITIPVIKR

SEQ ID NO: 432 - protein, 12 aa, Artificial Sequence
  Description of Artificial Sequence: Synthetic peptide
TYHSERTVTFTY

SEQ ID NO: 433 - protein, 12 aa, Artificial Sequence
  Description of Artificial Sequence: Synthetic peptide
PGSNYSEGWHIS

SEQ ID NO: 434 - protein, 12 aa, Artificial Sequence
  Description of Artificial Sequence: Synthetic peptide
LCANKKSSVKIT

SEQ ID NO: 435 - protein, 12 aa, Artificial Sequence
  Description of Artificial Sequence: Synthetic peptide
DGSPDYQKAKLQ

SEQ ID NO: 436 - protein, 12 aa, Artificial Sequence
  Description of Artificial Sequence: Synthetic peptide
VRRQLPVEEPNP

SEQ ID NO: 437 - protein, 12 aa, Artificial Sequence
  Description of Artificial Sequence: Synthetic peptide
KLNQVVRKVSAL

SEQ ID NO: 438 - protein, 12 aa, Artificial Sequence
  Description of Artificial Sequence: Synthetic peptide
ILRDYKQSSSTL

SEQ ID NO: 439 - protein, 13 aa, Artificial Sequence
  Description of Artificial Sequence: Synthetic peptide
DPAKYARWKPWLK

SEQ ID NO: 440 - protein, 13 aa, Artificial Sequence
  Description of Artificial Sequence: Synthetic peptide
QLRFNKPVRYAAT

SEQ ID NO: 441 - protein, 13 aa, Artificial Sequence
  Description of Artificial Sequence: Synthetic peptide
ELRFNKCVRLCGT

SEQ ID NO: 442 - protein, 13 aa, Artificial Sequence
  Description of Artificial Sequence: Synthetic peptide
GLKDQVNTVGIPI

SEQ ID NO: 443 - protein, 14 aa, Artificial Sequence
  Description of Artificial Sequence: Synthetic peptide
YKTSQNALDFNTKV

SEQ ID NO: 444 - protein, 14 aa, Artificial Sequence
  Description of Artificial Sequence: Synthetic peptide
PSENKENSAVPVEE

SEQ ID NO: 445 - protein, 14 aa, Artificial Sequence
  Description of Artificial Sequence: Synthetic peptide
ARTKISDDDDEHTL

SEQ ID NO: 446 - protein, 14 aa, Artificial Sequence
  Description of Artificial Sequence: Synthetic peptide
PITKWLPAYKFKEY

SEQ ID NO: 447 - protein, 14 aa, Artificial Sequence
  Description of Artificial Sequence: Synthetic peptide
SNLDEVGQQVERLD

SEQ ID NO: 448 - protein, 14 aa, Artificial Sequence
  Description of Artificial Sequence: Synthetic peptide
RATASLNANEVEWF

SEQ ID NO: 449 - protein, 15 aa, Artificial Sequence
  Description of Artificial Sequence: Synthetic peptide
EMRFSRAVRLCGTLQ

SEQ ID NO: 450 - protein, 15 aa, Artificial Sequence
  Description of Artificial Sequence: Synthetic peptide
RICSLTASEGPQQKI

SEQ ID NO: 451 - protein, 11 aa, Artificial Sequence
  Description of Artificial Sequence: Synthetic peptide
PLSPYGDIIEK

SEQ ID NO: 452 - protein, 15 aa, Artificial Sequence
  Description of Artificial Sequence: Synthetic peptide
TSESKENCTGVQVAE

SEQ ID NO: 453 - protein, 15 aa, Artificial Sequence
  Description of Artificial Sequence: Synthetic peptide
SQMNPRSPPATMCSP

SEQ ID NO: 454 - protein, 15 aa, Artificial Sequence
  Description of Artificial Sequence: Synthetic peptide
MHPDALEEPDDQNRI

SEQ ID NO: 455 - protein, 15 aa, Artificial Sequence
  Description of Artificial Sequence: Synthetic peptide
LSRMQHQSQECKSEE

SEQ ID NO: 456 - protein, 16 aa, Artificial Sequence
  Description of Artificial Sequence: Synthetic peptide
QEPNESDLPYHEMETL

SEQ ID NO: 457 - protein, 16 aa, Artificial Sequence
  Description of Artificial Sequence: Synthetic peptide
SRENSSSQDPQTEGTR

SEQ ID NO: 458 - protein, 16 aa, Artificial Sequence
  Description of Artificial Sequence: Synthetic peptide
EPSGHEKEGFMEAEQC

SEQ ID NO: 459 - protein, 16 aa, Artificial Sequence
  Description of Artificial Sequence: Synthetic peptide
KGSNYHLSDNDASDVE

SEQ ID NO: 460 - protein, 16 aa, Artificial Sequence
  Description of Artificial Sequence: Synthetic peptide
HTQSAEPPPPPEPARI

SEQ ID NO: 461 - protein, 16 aa, Artificial Sequence
  Description of Artificial Sequence: Synthetic peptide
CLISEERNECVIATEV

SEQ ID NO: 462 - protein, 16 aa, Artificial Sequence
  Description of Artificial Sequence: Synthetic peptide
ASWATNLKSSIRKANK

SEQ ID NO: 463 - protein, 17 aa, Artificial Sequence
  Description of Artificial Sequence: Synthetic peptide
TSMQPTEAMGEEPSRAE

SEQ ID NO: 464 - protein, 17 aa, Artificial Sequence
  Description of Artificial Sequence: Synthetic peptide
LSQEHRLLRHSSMADKK

SEQ ID NO: 465 - protein, 17 aa, Artificial Sequence
  Description of Artificial Sequence: Synthetic peptide
YSQKPPKRASSQLSWFS

SEQ ID NO: 466 - protein, 18 aa, Artificial Sequence
  Description of Artificial Sequence: Synthetic peptide
PRRPGEPREVHIGRALGR

SEQ ID NO: 467 - protein, 18 aa, Artificial Sequence
  Description of Artificial Sequence: Synthetic peptide
DTLSTRPGYLWVVWIYRN

SEQ ID NO: 468 - protein, 18 aa, Artificial Sequence
  Description of Artificial Sequence: Synthetic peptide
SIMNADILNYCQKESWCK

SEQ ID NO: 469 - protein, 18 aa, Artificial Sequence
  Description of Artificial Sequence: Synthetic peptide
NRGPPLDRAEVYSSKLQD

SEQ ID NO: 470 - protein, 19 aa, Artificial Sequence
  Description of Artificial Sequence: Synthetic peptide
ISKLSHSKGHQKRKALKTT

SEQ ID NO: 471 - protein, 19 aa, Artificial Sequence
  Description of Artificial Sequence: Synthetic peptide
DQNVNEAMPSLKITNDYIF

SEQ ID NO: 472 - protein, 16 aa, Artificial Sequence
  Description of Artificial Sequence: Synthetic peptide
DNSPLRRKSIYLVIIV

SEQ ID NO: 473 - protein, 19 aa, Artificial Sequence
  Description of Artificial Sequence: Synthetic peptide
QGQRSDVYSDLNTQRPYYK

SEQ ID NO: 474 - protein, 19 aa, Artificial Sequence
  Description of Artificial Sequence: Synthetic peptide
EIYLEPLKDAGDGVRYLLR

SEQ ID NO: 475 - protein, 19 aa, Artificial Sequence
  Description of Artificial Sequence: Synthetic peptide
LKHDTNIYCRMDHKAEVAS

SEQ ID NO: 476 - protein, 19 aa, Artificial Sequence
  Description of Artificial Sequence: Synthetic peptide
QWPALKEKYPKSVYLGRIV

SEQ ID NO: 477 - protein, 20 aa, Artificial Sequence
  Description of Artificial Sequence: Synthetic peptide
GKIFSSCFHNTILCMQKESE

SEQ ID NO: 478 - protein, 20 aa, Artificial Sequence
  Description of Artificial Sequence: Synthetic peptide
LDDHDYGSWGNYNNPLYDDS

SEQ ID NO: 479 - protein, 20 aa, Artificial Sequence
  Description of Artificial Sequence: Synthetic peptide
VRENHGLLPPLYKSVKTYTV

SEQ ID NO: 480 - protein, 20 aa, Artificial Sequence
  Description of Artificial Sequence: Synthetic peptide
PCTAQECLASVLKPTNETLN

SEQ ID NO: 481 - protein, 20 aa, Artificial Sequence
  Description of Artificial Sequence: Synthetic peptide
PNCNKPRWEKWFMVTFASST

SEQ ID NO: 482 - protein, 21 aa, Artificial Sequence
  Description of Artificial Sequence: Synthetic peptide
GYKAFGLVGKLAASGSITMQN

SEQ ID NO: 483 - protein, 21 aa, Artificial Sequence
  Description of Artificial Sequence: Synthetic peptide
FGRTVAIKPPKCWTGRFLMNL

SEQ ID NO: 484 - protein, 21 aa, Artificial Sequence
  Description of Artificial Sequence: Synthetic peptide
FRRTVSSKTPKCPTGRLLMNL

SEQ ID NO: 485 - protein, 21 aa, Artificial Sequence
  Description of Artificial Sequence: Synthetic peptide
NFHGMNPSKDTSTEYSEVRTQ

SEQ ID NO: 486 - protein, 21 aa, Artificial Sequence
  Description of Artificial Sequence: Synthetic peptide
HNPTLQVFRKTALLGANGAQP

SEQ ID NO: 487 - protein, 21 aa, Artificial Sequence
  Description of Artificial Sequence: Synthetic peptide
GELSLASLHIPFVETQHQTQV

SEQ ID NO: 488 - protein, 22 aa, Artificial Sequence
  Description of Artificial Sequence: Synthetic peptide
GEEGVALPANGAGGPGGASARK

SEQ ID NO: 489 - protein, 22 aa, Artificial Sequence
  Description of Artificial Sequence: Synthetic peptide
DRRSNQVARALHDHLGLRQGDC

SEQ ID NO: 490 - protein, 22 aa, Artificial Sequence
  Description of Artificial Sequence: Synthetic peptide
NHRVDASSMWLYRRYYSNVCQR

SEQ ID NO: 491 - protein, 22 aa, Artificial Sequence
  Description of Artificial Sequence: Synthetic peptide
QKMDSLDAMEGDVELEWEETTM

SEQ ID NO: 492 - protein, 23 aa, Artificial Sequence
  Description of Artificial Sequence: Synthetic peptide
FHTLRGKGQAAEPPDFNPRDSYS

SEQ ID NO: 493 - protein, 23 aa, Artificial Sequence
  Description of Artificial Sequence: Synthetic peptide
SVYQYGSALAHFFYSSDQAWYDR

SEQ ID NO: 494 - protein, 23 aa, Artificial Sequence
  Description of Artificial Sequence: Synthetic peptide
DSAEAPADPFAVPEGRSQDARGY

SEQ ID NO: 495 - protein, 23 aa, Artificial Sequence
  Description of Artificial Sequence: Synthetic peptide
SAGNGGSSLSYTNPAVAATSANL

SEQ ID NO: 496 - protein, 23 aa, Artificial Sequence
  Description of Artificial Sequence: Synthetic peptide
KAKLQSSPDYLQVLEEQTALNKI

SEQ ID NO: 497 - protein, 24 aa, Artificial Sequence
  Description of Artificial Sequence: Synthetic peptide
LLKGLGRRQACGYCVFWLLNPLPM

SEQ ID NO: 498 - protein, 24 aa, Artificial Sequence
  Description of Artificial Sequence: Synthetic peptide
SRGLQGTYQDVGSLNIGDVQLEKP

SEQ ID NO: 499 - protein, 24 aa, Artificial Sequence
  Description of Artificial Sequence: Synthetic peptide
APVVFFYLSQDSRPRSWCLRTVCN

SEQ ID NO: 500 - protein, 24 aa, Artificial Sequence
  Description of Artificial Sequence: Synthetic peptide
HFHKVQPQEPKVTDTEYSEIKIHK

SEQ ID NO: 501 - protein, 24 aa, Artificial Sequence
  Description of Artificial Sequence: Synthetic peptide
SISLHGLSQVSEDPPSVFNMPEAD

SEQ ID NO: 502 - protein, 24 aa, Artificial Sequence
  Description of Artificial Sequence: Synthetic peptide
VNNCEHFVTLLRYGEGVSEQANRA

SEQ ID NO: 503 - protein, 24 aa, Artificial Sequence
  Description of Artificial Sequence: Synthetic peptide
QNWGPRFKKLADLYGSKDTFDDDS

SEQ ID NO: 504 - protein, 25 aa, Artificial Sequence
  Description of Artificial Sequence: Synthetic peptide
KLRSDCSRPSLQWYTRAQSKMRRPS

SEQ ID NO: 505 - protein, 25 aa, Artificial Sequence
  Description of Artificial Sequence: Synthetic peptide
DHSRSTKAVSEKKAKGLGESRKDKK

SEQ ID NO: 506 - protein, 25 aa, Artificial Sequence
  Description of Artificial Sequence: Synthetic peptide
STGLTWRSGTASSVSYPKQMPLSQV

SEQ ID NO: 507 - protein, 25 aa, Artificial Sequence
  Description of Artificial Sequence: Synthetic peptide
AATVFFCLGQTTRPRSWCLRLVCNP

SEQ ID NO: 508 - protein, 26 aa, Artificial Sequence
  Description of Artificial Sequence: Synthetic peptide
YAANPVITPEPVTSPPSYSSEIQANK

SEQ ID NO: 509 - protein, 26 aa, Artificial Sequence
  Description of Artificial Sequence: Synthetic peptide
NHCVFTQRKITRPSQRPKTPPTDTSV

SEQ ID NO: 510 - protein, 26 aa, Artificial Sequence
  Description of Artificial Sequence: Synthetic peptide
TQGAKEHEEAESGEGTRRRAAEAPSM

SEQ ID NO: 511 - protein, 27 aa, Artificial Sequence
  Description of Artificial Sequence: Synthetic peptide
DHLALSRPRRLSTADPADASTIYAVVV

SEQ ID NO: 512 - protein, 27 aa, Artificial Sequence
  Description of Artificial Sequence: Synthetic peptide
STSALSEAASDTTQEPPGSHEYAALKV

SEQ ID NO: 513 - protein, 27 aa, Artificial Sequence
  Description of Artificial Sequence: Synthetic peptide
SFHKGEPQDLSGQEATNNEYSEIKIPK

SEQ ID NO: 514 - protein, 27 aa, Artificial Sequence
  Description of Artificial Sequence: Synthetic peptide
EGALHRSSMQPDNSSDSDYDLHGAQRL

SEQ ID NO: 515 - protein, 27 aa, Artificial Sequence
  Description of Artificial Sequence: Synthetic peptide
SFHKARPQYPQEQEAIGYEYSEINIPK

SEQ ID NO: 516 - protein, 27 aa, Artificial Sequence
  Description of Artificial Sequence: Synthetic peptide
SFQMVKPWDSRGQEATDTEYSEIKIHR

SEQ ID NO: 517 - protein, 27 aa, Artificial Sequence
  Description of Artificial Sequence: Synthetic peptide
IFPGGNKGGGTSCGPAQNPPNNQTPSS

SEQ ID NO: 518 - protein, 28 aa, Artificial Sequence
  Description of Artificial Sequence: Synthetic peptide
ELPTATQAQNDYGPQQKSSSSRPSCSCL

SEQ ID NO: 519 - protein, 28 aa, Artificial Sequence
  Description of Artificial Sequence: Synthetic peptide
KVPAEEPANELPMNEIEAWKAAEKKARW

SEQ ID NO: 520 - protein, 28 aa, Artificial Sequence
  Description of Artificial Sequence: Synthetic peptide
SHQWKSSEDNSKTFSASHNVEATSMFQL

SEQ ID NO: 521 - protein, 28 aa, Artificial Sequence
  Description of Artificial Sequence: Synthetic peptide
KEEEMADTSYGTVKAENIIMMETAQTSL

SEQ ID NO: 522 - protein, 28 aa, Artificial Sequence
  Description of Artificial Sequence: Synthetic peptide
NLTALDWSLLSKKECLSYGGRLLGNSCK

SEQ ID NO: 523 - protein, 28 aa, Artificial Sequence
  Description of Artificial Sequence: Synthetic peptide
SFSEMKSREPKDQEAPSTTEYSEIKTSK

SEQ ID NO: 524 - protein, 28 aa, Artificial Sequence
  Description of Artificial Sequence: Synthetic peptide
ELIKPHRAAKGAPTSTVYAQILFEENKL

SEQ ID NO: 525 - protein, 29 aa, Artificial Sequence
  Description of Artificial Sequence: Synthetic peptide
NHSVIGPNSRLARNVKEAPTEYASICVRS

SEQ ID NO: 526 - protein, 29 aa, Artificial Sequence
  Description of Artificial Sequence: Synthetic peptide
DLASQPVYCNLQSLGQAPMDEEEYVIPGH

SEQ ID NO: 527 - protein, 29 aa, Artificial Sequence
  Description of Artificial Sequence: Synthetic peptide
DYDNSENQLFLEEERRINHTAFRTVEIKR

SEQ ID NO: 528 - protein, 25 aa, Artificial Sequence
  Description of Artificial Sequence: Synthetic peptide
DHSGGHHSDKINKSESVVYADIRKN

SEQ ID NO: 529 - protein, 33 aa, Artificial Sequence
  Description of Artificial Sequence: Synthetic polypeptide
DHWALTQRTARAVSPQSTKPMAESITYAAVARH

SEQ ID NO: 530 - protein, 18 aa, Artificial Sequence
  Description of Artificial Sequence: Synthetic peptide
ENLIYENVAAIQAHKLEV

SEQ ID NO: 531 - protein, 30 aa, Artificial Sequence
  Description of Artificial Sequence: Synthetic polypeptide
SETTGLTPDQVKRNLEKYGLNELPAEEGKT

SEQ ID NO: 532 - protein, 18 aa, Artificial Sequence
  Description of Artificial Sequence: Synthetic peptide
SLCYKFLSYFRASSTMRY

SEQ ID NO: 533 - protein, 30 aa, Artificial Sequence
  Description of Artificial Sequence: Synthetic polypeptide
KLEKLVSSLREEDEYSIHPPSSRWKRFYRA

SEQ ID NO: 534 - protein, 26 aa, Artificial Sequence
  Description of Artificial Sequence: Synthetic peptide
SHLRKIRTCTSIMEKDLTYSSVKRHL

SEQ ID NO: 535 - protein, 31 aa, Artificial Sequence
  Description of Artificial Sequence: Synthetic polypeptide
ALSSSTSPRAPPSHRPLKSPQNETLYSVLKA

SEQ ID NO: 536 - protein, 32 aa, Artificial Sequence
  Description of Artificial Sequence: Synthetic polypeptide
DPENQNFLLESNLGKKKYETEFHPGTTSFGMS

SEQ ID NO: 537 - protein, 32 aa, Artificial Sequence
  Description of Artificial Sequence: Synthetic polypeptide
FTYGVRFLKKTPWLWNTRHCWYNYPYQPLTTD

SEQ ID NO: 538 - protein, 32 aa, Artificial Sequence
  Description of Artificial Sequence: Synthetic polypeptide
KTLRSLEATDSAFDNPDYWHSRLFPKANAQRT

SEQ ID NO: 539 - protein, 33 aa, Artificial Sequence
  Description of Artificial Sequence: Synthetic polypeptide
QFQNSSEMEKIPEIGKFGEKAPPAPSHVWRPAA

SEQ ID NO: 540 - protein, 33 aa, Artificial Sequence
  Description of Artificial Sequence: Synthetic polypeptide
TFQDSAGARNNRDGNNLRKRGHPAPSPIWRHAA

SEQ ID NO: 541 - protein, 33 aa, Artificial Sequence
  Description of Artificial Sequence: Synthetic polypeptide
LALSSGSRKASAVGDVVNLVSVDVQRLTESVLY

SEQ ID NO: 542 - protein, 33 aa, Artificial Sequence
  Description of Artificial Sequence: Synthetic polypeptide
DILRPYFDVEPAQVRSRLLESMIPIKMVNFPQK

SEQ ID NO: 543 - protein, 33 aa, Artificial Sequence
  Description of Artificial Sequence: Synthetic polypeptide
TCQFEGLLRPYIQHAMYDEEKGTPIFICPVSWG

SEQ ID NO: 544 - protein, 34 aa, Artificial Sequence
  Description of Artificial Sequence: Synthetic polypeptide
LQLDKVDVIPVTAINLYPDGPEKRAENLEDKTCI

SEQ ID NO: 545 - protein, 34 aa, Artificial Sequence
  Description of Artificial Sequence: Synthetic polypeptide
CPVFKGFSSSSKDQIAIPEDTPENTETASVCTKV

SEQ ID NO: 546 - protein, 30 aa, Artificial Sequence
  Description of Artificial Sequence: Synthetic polypeptide
NFEAQQPTQPTSASPSLTATEIIYSEVKKQ

SEQ ID NO: 547 - protein, 31 aa, Artificial Sequence
  Description of Artificial Sequence: Synthetic polypeptide
WSMQQPESSANIRTLLENKDSQVIYSSVKKS

SEQ ID NO: 548 - protein, 36 aa, Artificial Sequence
  Description of Artificial Sequence: Synthetic polypeptide
GRQPGKREPLRSVLRRALGEGAELGARGQSLPMGLL

SEQ ID NO: 549 - protein, 36 aa, Artificial Sequence
  Description of Artificial Sequence: Synthetic polypeptide
PDWLKDNDYLLHGHRPPMPSFRACFKSIFRIHTETG

SEQ ID NO: 550 - protein, 36 aa, Artificial Sequence
  Description of Artificial Sequence: Synthetic polypeptide
DGSHIHTFLDVSFSEALYPVFRILTLEPTALTICPA

SEQ ID NO: 551 - protein, 33 aa, Artificial Sequence; identical to SEQ ID NO: 529
  Description of Artificial Sequence: Synthetic polypeptide

SEQ ID NO: 552 - protein, 33 aa, Artificial Sequence
  Description of Artificial Sequence: Synthetic polypeptide
HSLTLRREATEPPPSQEREPPAEPSIYAPLAIH

SEQ ID NO: 553 - protein, 38 aa, Artificial Sequence
  Description of Artificial Sequence: Synthetic polypeptide
RFKNEFKSSGINTASSAASKERTAPHKSNTGFPKLLCA

SEQ ID NO: 554 - protein, 39 aa, Artificial Sequence
  Description of Artificial Sequence: Synthetic polypeptide
REKMWHGRQRLGGVGAGSRPPMPAHPTPASIFSARSTDV

SEQ ID NO: 555 - protein, 39 aa, Artificial Sequence
  Description of Artificial Sequence: Synthetic polypeptide
KKTHPDDSAGEASSRGRAHEEDDEENYENVPRVLLASDH

SEQ ID NO: 556 - protein, 40 aa, Artificial Sequence
  Description of Artificial Sequence: Synthetic polypeptide
GSAQGRRLPLRLVLQRALGDEAELGAVRETSRRGLVDIAA

SEQ ID NO: 557 - protein, 40 aa, Artificial Sequence
  Description of Artificial Sequence: Synthetic polypeptide
SSPTSPTSPGPQQAPPRETYLSEKIPIPDTKPGTFSLRKL

SEQ ID NO: 558 - protein, 40 aa, Artificial Sequence
  Description of Artificial Sequence: Synthetic polypeptide
AGFPKTRLGRLATSTSRSRQLSLCDDYEEQTDEYFFDRDP

SEQ ID NO: 559 - protein, 40 aa, Artificial Sequence
  Description of Artificial Sequence: Synthetic polypeptide
KSLMARRTYLEWPKEKSKRGLFWANLRAAINIKLTEQAKK

SEQ ID NO: 560 - protein, 41 aa, Artificial Sequence
  Description of Artificial Sequence: Synthetic polypeptide
LPWEPSLESEEEVEEEETSEALVLNPRRHQDSSRNKAGGLP

SEQ ID NO: 561 - protein, 41 aa, Artificial Sequence
  Description of Artificial Sequence: Synthetic polypeptide
KESDHFSTELDDITVTDTYLSATKVSFDDTCLASEVSFSQS

SEQ ID NO: 562 - protein, 41 aa, Artificial Sequence
  Description of Artificial Sequence: Synthetic polypeptide
QNLCSRLKTSPVEGLSGNPADLEKRRQVFGHNVIPPKKPKT

SEQ ID NO: 563 - protein, 35 aa, Artificial Sequence
  Description of Artificial Sequence: Synthetic polypeptide
NHCVFTQRKITRPSQRPKTPPTDIIVYTELPNAEP

SEQ ID NO: 564 - protein, 33 aa, Artificial Sequence
  Description of Artificial Sequence: Synthetic polypeptide
TMKTSDKFKFVFREKMGRIVDYFTIQNPSNVDH

SEQ ID NO: 565 - protein, 43 aa, Artificial Sequence
  Description of Artificial Sequence: Synthetic polypeptide
SENFRKAYKQVFKCHIRKDSHLSDTKESKSRIDTPPSTNCTHV

SEQ ID NO: 566 - protein, 43 aa, Artificial Sequence
  Description of Artificial Sequence: Synthetic polypeptide
EFMNEQKLNRYPASSLVVVRSKTEDHEEAGPLPTKVNLAHSEI

SEQ ID NO: 567 - protein, 43 aa, Artificial Sequence
  Description of Artificial Sequence: Synthetic polypeptide
GNYRLKEYEKALKYVRGLLQTEPQNNQAKELERLIDKAMKKDG

SEQ ID NO: 568 - protein, 43 aa, Artificial Sequence
  Description of Artificial Sequence: Synthetic polypeptide
PAGEEDEEEEEDLGWGCPDVAGPTRPTAPPDLHNYMRRIKEIA

SEQ ID NO: 569 - protein, 43 aa, Artificial Sequence
  Description of Artificial Sequence: Synthetic polypeptide
SGLREQTIAIKCLVVLVVALGLPFLAIGYWIAPCSRLGKILRS

SEQ ID NO: 570 - protein, 43 aa, Artificial Sequence
  Description of Artificial Sequence: Synthetic polypeptide
SGLRQQTMAVKFLVVLAVAIGLPFLALIYWFAPCSKMGKIMRG

SEQ ID NO: 571 - protein, 43 aa, Artificial Sequence; identical to SEQ ID NO: 570
  Description of Artificial Sequence: Synthetic polypeptide

SEQ ID NO: 572 - protein, 44 aa, Artificial Sequence
  Description of Artificial Sequence: Synthetic polypeptide
PPVSRAYTTACVLTTAAVQLELITPFQLYFNPELIFKHFQIWRL

SEQ ID NO: 573 - protein, 44 aa, Artificial Sequence
  Description of Artificial Sequence: Synthetic polypeptide
GNVLILRSVSTAVYKRFPSAQHLVQAGFMTPAEHKQLEKLSLPH

SEQ ID NO: 574 - protein, 44 aa, Artificial Sequence
  Description of Artificial Sequence: Synthetic polypeptide
QNWWTRRKVRQEHGPERKISFPQWEKDYNLQPMNAYGLFDEYLE

SEQ ID NO: 575 - protein, 45 aa, Artificial Sequence
  Description of Artificial Sequence: Synthetic polypeptide
DSNIAFSVNASDKGEASCCDPVSAAFEGCLRRLFTRWGSFCVRNP

SEQ ID NO: 576 - protein, 45 aa, Artificial Sequence
  Description of Artificial Sequence: Synthetic polypeptide
QVSSAESHKDLGKKDTETVYSEVRKAVPDAVESRYSRTEGSLDGT

SEQ ID NO: 577 - protein, 45 aa, Artificial Sequence
  Description of Artificial Sequence: Synthetic polypeptide
VLDSEPKSQASGPEPELYASVCAQTRRARASFPDQAYANSQPAAS

SEQ ID NO: 578 - protein, 46 aa, Artificial Sequence
  Description of Artificial Sequence: Synthetic polypeptide
ETGINLRGALLAMIYNKILRLSTSNLSMGEMTLGQINNLVAIETNQ

SEQ ID NO: 579 - protein, 46 aa, Artificial Sequence
  Description of Artificial Sequence: Synthetic polypeptide
AAGRARAKACRAPGSYGRGTHCHYKAPTVVLHMTKTDPSLENPTHL

SEQ ID NO: 580 - protein, 46 aa, Artificial Sequence
  Description of Artificial Sequence: Synthetic polypeptide
HHELLSHKSFETNAQEDTMETHLETELDLSTITTAGRISDHKQQLA

SEQ ID NO: 581 - protein, 47 aa, Artificial Sequence
  Description of Artificial Sequence: Synthetic polypeptide
DQKYVLILNVFPAPPKRSFLPQVLTEWYIPLEKDERHQWIVLLSFQL

SEQ ID NO: 582 - protein, 47 aa, Artificial Sequence
  Description of Artificial Sequence: Synthetic polypeptide
LQTVYLGKNSEAQPARQILVLDNAAIVCNFGSELSLVYVPSVLEKLD

SEQ ID NO: 583 - protein, 48 aa, Artificial Sequence
  Description of Artificial Sequence: Synthetic polypeptide
RKDSEEEVSLLGSQDIEEGNHQVEDGCREMACEEFNFGEILMTQVIHS

SEQ ID NO: 584 - protein, 47 aa, Artificial Sequence
  Description of Artificial Sequence: Synthetic polypeptide
QRRETEVYACIENEDGSSPTAKQSPLSQERPHRFEDDGELNLVYENL

SEQ ID NO: 585 - protein, 48 aa, Artificial Sequence
  Description of Artificial Sequence: Synthetic polypeptide
APCAKVRPYIAEGESDTDSDLCTPCGPPPRSATGEGPFGDVGWAGPRK

SEQ ID NO: 586 - protein, 49 aa, Artificial Sequence
  Description of Artificial Sequence: Synthetic polypeptide
ERLGYSEDGLEELSRHSVSEADRLLSARSSVDFQAFGVKGGRRINEYFC

SEQ ID NO: 587 - protein, 49 aa, Artificial Sequence
  Description of Artificial Sequence: Synthetic polypeptide
RQRLCRQSVLLWPHQPSGQRSFWAQLGMALTRDNHHFYNRNFCQGPTAE

SEQ ID NO: 588 - protein, 49 aa, Artificial Sequence
  Description of Artificial Sequence: Synthetic polypeptide
LHRDYDRTVTLLSPPRPGRLPDLQEIGVPLYQSPPGRYLSPKKGANENV

SEQ ID NO: 589 - protein, 50 aa, Artificial Sequence
  Description of Artificial Sequence: Synthetic polypeptide
RSPFYDRFSEARILFLLQLLADHVPGVGLVTRPLMDYLPTWQKIYFYSWG

SEQ ID NO: 590 - protein, 50 aa, Artificial Sequence
  Description of Artificial Sequence: Synthetic polypeptide
NPSPDTRIELNDVVYLIRPDPLAYLPNSEPSRRNSICNVTGQDSREETQL

SEQ ID NO: 591 - protein, 51 aa, Artificial Sequence
  Description of Artificial Sequence: Synthetic polypeptide
RDIYAQRMHTFITSLSSVGIVVSDPDSTDASSIEDNEDICNTTSLENCTAK

SEQ ID NO: 592 - protein, 51 aa, Artificial Sequence
  Description of Artificial Sequence: Synthetic polypeptide
SFQGLRLWEPADQEAPSTTEYSEIKIHTGQPLRGPGFGLQLEREMSGMVPK

SEQ ID NO: 593 - protein, 51 aa, Artificial Sequence
  Description of Artificial Sequence: Synthetic polypeptide
LVSSVADVLAQGGGPRSSQHCGEGSQLVAADHRGGLDGWEQPGAGQPPSDT

SEQ ID NO: 594 - protein, 51 aa, Artificial Sequence
  Description of Artificial Sequence: Synthetic polypeptide
VVSDSGISTDYSSGDSQGAQGGLSDGPYSNPYENSLIPAAEPLPPSYVACS

SEQ ID NO: 595 - protein, 53 aa, Artificial Sequence
  Description of Artificial Sequence: Synthetic polypeptide
NPPPDTRLEPSDIVYLIRSDPLAHVASSSQSRKSSCSHKLSSCNPETRDETQL

SEQ ID NO: 596 - protein, 54 aa, Artificial Sequence
  Description of Artificial Sequence: Synthetic polypeptide
HPSCCWKPDPDQVDGARSLLSPEGYQLPQNRRMTHLAQKFFPKAKDEAASPVKG

SEQ ID NO: 597 - protein, 54 aa, Artificial Sequence
  Description of Artificial Sequence: Synthetic polypeptide
GKKFKRYFLQLLKYIPPKAKSHSNLSTKMSTLSYRPSDNVSSSTKKPAPCFEVE

SEQ ID NO: 598 - protein, 54 aa, Artificial Sequence
  Description of Artificial Sequence: Synthetic polypeptide
SDNFKKSFQNVLCLVKVSGTDDGERSDSKQDKSRLNETTETQRTLLNGDLQTSI

SEQ ID NO: 599 - protein, 54 aa, Artificial Sequence
  Description of Artificial Sequence: Synthetic polypeptide
SPTNNTVYASVTHSNRETEIWTPRENDTITIYSTINHSKESKPTFSRATALDNV

SEQ ID NO: 600 - protein, 55 aa, Artificial Sequence
  Description of Artificial Sequence: Synthetic polypeptide
LGGAAYVNTFHNIALETSDEHREFAMAATCISDTLGISLSGLLALPLHDFLCQLS

SEQ ID NO: 601 - protein, 35 aa, Artificial Sequence
  Description of Artificial Sequence: Synthetic polypeptide
MQKDSSQETTSCYEKIFYGHLLKKFRQPNFARKLC

SEQ ID NO: 602 - protein, 56 aa, Artificial Sequence
  Description of Artificial Sequence: Synthetic polypeptide
ALATSKALVKFDPEIIGPRDIIKIIEEIGFHASLAQRNPNAHHLDHKMEIKQWKKS

SEQ ID NO: 603 - protein, 43 aa, Artificial Sequence
  Description of Artificial Sequence: Synthetic polypeptide
NHCVFTQRKITRPSQRPKTPPTDIIVYTELPNAESRSKVVSCP

SEQ ID NO: 604 - protein, 43 aa, Artificial Sequence
  Description of Artificial Sequence: Synthetic polypeptide
DHCVFTQRKITRPSQRPKTPPTDTILYTELPNAKPRSKVVSCP

SEQ ID NO: 605 - protein, 58 aa, Artificial Sequence
  Description of Artificial Sequence: Synthetic polypeptide
ERKRIQYLHAKLLKKRSKQPLGEVKRRLSLYLTKIHFWLPVLKMIRKKQMDMASADKS

SEQ ID NO: 606 - protein, 58 aa, Artificial Sequence
  Description of Artificial Sequence: Synthetic polypeptide
SEWLESIRMKRYILHFHSAGLDTMECVLELTAEDLTQMGITLPGHQKRILCSIQGFKD

SEQ ID NO: 607 - protein, 59 aa, Artificial Sequence
  Description of Artificial Sequence: Synthetic polypeptide
NADAKYPGYPPEHIIAEKRRARRRLLHKDGSCNVYFKHIFGEWGSYVVDIFTTLVDTKW

SEQ ID NO: 608 - protein, 60 aa, Artificial Sequence
  Description of Artificial Sequence: Synthetic polypeptide
HRTSKRSEARSAEFTVGRKDSSIICAEVRCLQPSEVSSTEVNMRSRTLQEPLSDCEEVLC

SEQ ID NO: 609 - protein, 61 aa, Artificial Sequence
  Description of Artificial Sequence: Synthetic polypeptide
IKYWFHTPPSIPLQIEEYLKDPTQPILEALDKDSSPKDDVWDSVSIISFPEKEQEDVLQTL

SEQ ID NO: 610 - protein, 62 aa, Artificial Sequence
  Description of Artificial Sequence: Synthetic polypeptide
RREPRQALAGTFRDLRLRLWPQGGGWVQQVALKQVGRRWVASNPRESRPSTLLTNLDRGTPG

SEQ ID NO: 611 - protein, 62 aa, Artificial Sequence
  Description of Artificial Sequence: Synthetic polypeptide
DFQWREKTPEPPVPCVPEQTEYATIVFPSGMGTSSPARRGSADGPRSAQPLRPEDGHCSWPL

SEQ ID NO: 612 - protein, 62 aa, Artificial Sequence
  Description of Artificial Sequence: Synthetic polypeptide
ENDEDGAQASPEPDGGVGTRDSSRTSIRSSQWSFSTISSSTQRSYNTCCSWTQHPLIQKNRR

SEQ ID NO: 613 - protein, 62 aa, Artificial Sequence
  Description of Artificial Sequence: Synthetic polypeptide
DEIYLESCCQARYHQKKEQMNEELKREAETLREREGEEFDNTCCAEKRKKLWDLLEKPNSSV

SEQ ID NO: 614 - protein, 64 aa, Artificial Sequence
  Description of Artificial Sequence: Synthetic polypeptide
DMRPPPTAMITLNNSVYWQEFEDTCVYECLDGKDCQSFFCCYEECKSGSWRKGRIHIDILELDS

SEQ ID NO: 615 - protein, 64 aa, Artificial Sequence
  Description of Artificial Sequence: Synthetic polypeptide
GTLAWMITLSDGLHNFIDGLAIGASFTVSVFQGISTSVAILCEEFPHELGDFVILLNAGMSIQQ

SEQ ID NO: 616 - protein, 64 aa, Artificial Sequence
  Description of Artificial Sequence: Synthetic polypeptide
GHNEVIGVCRVGPDAADPHGREHWAEMLANPRKPVEHWHQLVEEKTVTSFTKGSKGLSEKENSE

SEQ ID NO: 617 - protein, 66 aa, Artificial Sequence
  Description of Artificial Sequence: Synthetic polypeptide
PSLSTSNKNIYEVEPTVSVVQEGCGHNSSYIQNAYDLPRNSHIPGHYDLLPVRQSPANGPSQDKQS

SEQ ID NO: 618 - protein, 67 aa, Artificial Sequence
  Description of Artificial Sequence: Synthetic polypeptide
DEARLERCCLRRLRRREEEAAEARAGPTERGAQGSPARALGPRGRLQRGRRRLRDVVDNPHSGLAGK

SEQ ID NO: 619 - protein, 68 aa, Artificial Sequence
  Description of Artificial Sequence: Synthetic polypeptide
DELSIDSCCRDRYFRRKELSETLDFKKDTEDQESQHESEQDFSQGPCPTVRQKLWNILEKPGSSTAAR

SEQ ID NO: 620 - protein, 64 aa, Artificial Sequence
  Description of Artificial Sequence: Synthetic polypeptide
KETKVKELKRAKTVLTVIKWKGEKSKYPQGRFWKQLQVAMPVKKSPRRSSSDEQGLSYSSLKNV

SEQ ID NO: 621 - protein, 70 aa, Artificial Sequence
  Description of Artificial Sequence: Synthetic polypeptide
LSYNHHRLEEHEAETYEDGFTGNPSSLSQIPETNSEETTVIFEQLHSFVVDDDGFIEDKYIDIHELCEEN

SEQ ID NO: 622 - protein, 70 aa, Artificial Sequence
  Description of Artificial Sequence: Synthetic polypeptide
DESSSSPGRQMSSSDGGPPGQSDTDSSVEESDFDTMPDIESDKNIIRTKMFLYLSDLSRKDRRIVSKKYK

SEQ ID NO: 623 - protein, 50 aa, Artificial Sequence
  Description of Artificial Sequence: Synthetic polypeptide
RIIQEKKKHAVASDPRHLRNKGSPIIYSEVKVASTPVSGSLFLASSAPHR

SEQ ID NO: 624 - protein, 71 aa, Artificial Sequence
  Description of Artificial Sequence: Synthetic polypeptide
AEDHLDGCCKRRYLQKIEEFAEMVEREEEDDALDSEGRDSEGPAEGEGRLGRCMRRLRDMVERPHSGLPGK

SEQ ID NO: 625 - protein, 71 aa, Artificial Sequence
  Description of Artificial Sequence: Synthetic polypeptide
EDPWIGSESDKFILLGYLDQLRKDPALLSSEAVLPDLTDELAPVFLLRWFYSASDYISDCWDSIFHNNWRE

SEQ ID NO: 626 - protein, 72 aa, Artificial Sequence
  Description of Artificial Sequence: Synthetic polypeptide
MDRKWYFLCNSWLSINVGDCVLDKVFPVATEQDRKQFSHLFFMKTSAGFQDGHIWYSIFSRCARSSFTRVQR

SEQ ID NO: 627 - protein, 72 aa, Artificial Sequence
  Description of Artificial Sequence: Synthetic polypeptide
VPSDPSVEEMRKVVCEQKLRPNIPNRWQSCEALRVMAKIMRECWYANGAARLTALRIKKTLSQLSQQEGIKM

SEQ ID NO: 628 - protein, 72 aa, Artificial Sequence
  Description of Artificial Sequence: Synthetic polypeptide
CSDFQEDIVFPFSLGWSSLVHRFLGPRNAQRVLLGLSEPIFQLPRSLASTPTAPTTPATPDNASQEELMITL

SEQ ID NO: 629 - protein, 73 aa, Artificial Sequence
  Description of Artificial Sequence: Synthetic polypeptide
RIPLLGDEEEGSEDEGESTHLLPENENELEKFIHSVIISKRSKNIKKKLKEEQNSVTENKTKNASHNGKMEDL

SEQ ID NO: 630 - protein, 73 aa, Artificial Sequence
  Description of Artificial Sequence: Synthetic polypeptide
SKIPQITLNFVDLKGDPFLASPTSDREIIAPKIKERTHNVTEKVTQVLSLGADVLPEYKLQAPRIHRWTILHY

SEQ ID NO: 631 - protein, 74 aa, Artificial Sequence
  Description of Artificial Sequence: Synthetic polypeptide
DHCIFTQRKITGPSQRSKRPSTDTSVCIELPNAEPRALSPAHEHHSQALMGSSRETTALSQTQLASSNVPAAGI

SEQ ID NO: 632 - protein, 74 aa, Artificial Sequence
  Description of Artificial Sequence: Synthetic polypeptide
PRARIMQRKRGLEWFVCDGWKFLCTSCCGWLINICRRKKELKARTVWLGCPEKCEEKHPRNSIKNQKYNVFTFI

SEQ ID NO: 633 - protein, 74 aa, Artificial Sequence
  Description of Artificial Sequence: Synthetic polypeptide
SPRHYYSGYSSSPEYSSESTHKIWERFRPYKKHHREEVYMAAGHALRKKVQFAKDEDLHDILDYWKGVSAQQKL

SEQ ID NO: 634 - protein, 75 aa, Artificial Sequence
  Description of Artificial Sequence: Synthetic polypeptide
SPQYHSLSYSSSPEYTCRASQSIWERFRLSRRRHKEEEEFMAAGHALRKKVQFAKDEDLHDILDYWKGVSAQHKS

SEQ ID NO: 635 - protein, 76 aa, Artificial Sequence
  Description of Artificial Sequence: Synthetic polypeptide
MAFNAKVSDPLIGGTYMTLLNTVSNLGGNWPSTVALWLVDPLTVKECVGASNQNCRTPDAVELCKKLGGSCVTALD

SEQ ID NO: 636 - protein, 76 aa, Artificial Sequence
  Description of Artificial Sequence: Synthetic polypeptide
YYPHGHSHSLGLDLNLGLGSGTFHSLGNALVHGGELEMGHGGTHGFGYGVGHGLSHIHGDGYGVNHGGHYGHGGGH

SEQ ID NO: 637 - protein, 49 aa, Artificial Sequence
  Description of Artificial Sequence: Synthetic polypeptide
SFHKVKPQDPQGQEATDSEYSEIKIHKRETAETQACLRNHNPSSKEVRG

SEQ ID NO: 638 - protein, 76 aa, Artificial Sequence
  Description of Artificial Sequence: Synthetic polypeptide
NNSTSANRNVYEVEPTVSVVQGVFSNNGRLSQDPYDLPKNSHIPCHYDLLPVRDSSSSPKQEDSGGSSSNSSSSSE

SEQ ID NO: 639 - protein, 77 aa, Artificial Sequence
  Description of Artificial Sequence: Synthetic polypeptide
RREFRKALKSLLWRIASPSITSMRPFTATTKPEHEDQGLQAPAPPHAAAEPDLLYYPPGVVVYSGGRYDLLPSSSAY

SEQ ID NO: 640 - protein, 77 aa, Artificial Sequence
  Description of Artificial Sequence: Synthetic polypeptide
NELFIDSCCSNRYQERKEENHEKDWDQKSHDVSTDSSFEESSLFEKELEKFDTLRFGQLRKKIWIRMENPAYCLSAK

SEQ ID NO: 641 - protein, 77 aa, Artificial Sequence
  Description of Artificial Sequence: Synthetic polypeptide
NEFFIDSCCSYSYHGRKVEPEQEKWDEQSDQESTTSSFDEILAFYNDASKFDGQPLGNFRRQLWLALDNPGYSVLSR

SEQ ID NO: 642 - protein, 78 aa, Artificial Sequence
  Description of Artificial Sequence: Synthetic polypeptide
DATDQESLELKPTSRAGIKQKGLLLSSSLMHSESELDSDDAIFTWPDREKGKLLHGQNGSVPNGQTPLKARSPREEIL

SEQ ID NO: 643 - protein, 78 aa, Artificial Sequence
  Description of Artificial Sequence: Synthetic polypeptide
SRGASIPGTPPTAGRVVSLSPEDAPGPSLRRSGGCSPSSDTVFGPGAPAAAGAEACRRENRGTLYGTRSFTVSVAQKR

SEQ ID NO: 644 - protein, 79 aa, Artificial Sequence
  Description of Artificial Sequence: Synthetic polypeptide
NKTFSPAQRHGNSGITMMRKKAKFSLRENPVEETKGEAFSDGNIEVKLCEQTEEKKKLKRHLALFRSELAENSPLDSGH

SEQ ID NO: 645 - protein, 79 aa, Artificial Sequence
  Description of Artificial Sequence: Synthetic polypeptide
YESHRAGCEKYEGPYPQHPFYSSASGDVIGGLSREEIRQMYESSELSREEIQERMRVLELYANDPEFAAFVREQQVEEV

SEQ ID NO: 646 - protein, 79 aa, Artificial Sequence
  Description of Artificial Sequence: Synthetic polypeptide
FKNSDKEDDQEHPSEKQPSGAESGTLARASLALPTSSLSRTASQSSSHRGWEILRQNTLGHLNLGLNLSEGDGEEVYHF

SEQ ID NO: 647 - protein, 79 aa, Artificial Sequence
  Description of Artificial Sequence: Synthetic polypeptide
QDLKGDDTAVRDAHSKRDTKCQPQGSSGEEKGTPTTLRGGEASERKRPDSGCSTSKDTKYQSVYVISEEKDECVIATEV

SEQ ID NO: 648 - protein, 54 aa, Artificial Sequence
  Description of Artificial Sequence: Synthetic polypeptide
DHCVFIQRKISRPSQRPKTPLTDTSVYTELPNAEPRSKVVSCPRAPQSGLEGVF

SEQ ID NO: 649 - protein, 79 aa, Artificial Sequence
  Description of Artificial Sequence: Synthetic polypeptide
RDLPPLSSSEMEEFLTQESKKHENEFNEEVALTEIYKYIVKYFDEILNKLERERGLEEAQKQLLHVKVLFDEKKKCKWM

SEQ ID NO: 650 - protein, 81 aa, Artificial Sequence
  Description of Artificial Sequence: Synthetic polypeptide
LGSPTSPGPGHYLRCDSTQPLLAGLTPSPKSYENLWFQASPLGTLVTPAPSQEDDCVFGPLLNFPLLQGIRVHGMEALGSF

SEQ ID NO: 651 - protein, 81 aa, Artificial Sequence
  Description of Artificial Sequence: Synthetic polypeptide
LSQPGPTLPKTHVKTASLGLAGKARSPLLPVSVPTAPEVSEESHKPTEDSANVYEQDDLSEQMASLEGLMKQLNAITGSAF

SEQ ID NO: 652 - protein, 70 aa, Artificial Sequence
  Description of Artificial Sequence: Synthetic polypeptide
ATECGQGEEKSEGPLGSQESESCGLRKEEKEPHADKDFCQEKQVAYCPSGKPEGLNYACLTHSGYGDGSD

SEQ ID NO: 653 - protein, 82 aa, Artificial Sequence
  Description of Artificial Sequence: Synthetic polypeptide
KELILAVDGVLSVHSLHIWSLTMNQVILSAHVATAASRDSQVVRREIAKALSKSFTMHSLTIQMESPVDQDPDCLFCEDPCD

SEQ ID NO: 654 - protein, 82 aa, Artificial Sequence
  Description of Artificial Sequence: Synthetic polypeptide
TSFPRLPEDEPAPAAPLRGRKDEDAFLGDPDTDPDSFLKSARLQRLPSSSSEMGSQDGSPLRETRKDPFSAAAAECSCRQDG

SEQ ID NO: 655 - protein, 82 aa, Artificial Sequence
  Description of Artificial Sequence: Synthetic polypeptide
LEKERELQQLGITEYLRKNIAQLQPDMEAHYPGAHEELKLMETLMYSRPRKVLVEQTKNEYFELKANLHAEPDYLEVLEQQT

SEQ ID NO: 656 - protein, 83 aa, Artificial Sequence
  Description of Artificial Sequence: Synthetic polypeptide
KNSLKEANHDGDFGITLAELRALMELRSTDALRKIQESYGDVYGICTKLKTSPNEGLSGNPADLERREAVFGKNFIPPKKPKT

SEQ ID NO: 657 - protein, 83 aa, Artificial Sequence
  Description of Artificial Sequence: Synthetic polypeptide
YNCLDFPAGVVPVTTVTAEDEAQMEHYRGYFGDIWDKMLQKGMKKSVGLPVAVQCVALPWQEELCLRFMREVERLMTPEKQSS

SEQ ID NO: 658 - protein, 84 aa, Artificial Sequence
  Description of Artificial Sequence: Synthetic polypeptide
PAFDLLSRKMLGCPINDLNVILLFLRANISELISFSWLSVLCVLKDTTTQKHNIDTVVDFMTLLAGLEPSKPKHLTNSACDEHP

SEQ ID NO: 659 - protein, 85 aa, Artificial Sequence
  Description of Artificial Sequence: Synthetic polypeptide
SRRFQAAFQNVISSFHKQWHSQHDPQLPPAQRNIFLTECHFVELTEDIGPQFPCQSSMHNSHLPAALSSEQMSRTNYQSFHFNKT

SEQ ID NO: 660 - protein, 80 aa, Artificial Sequence
  Description of Artificial Sequence: Synthetic polypeptide
ELKTTRFHPNRQSSMYTVTRMESMTVVFDPNDADTTRSSRKKRATPRDPSFNGCSRRNSKSASATSSFISSPYTSVDEYS

SEQ ID NO: 661 - protein, 85 aa, Artificial Sequence
  Description of Artificial Sequence: Synthetic polypeptide
SRQCKQFAKDLLDQTRSSRELEIILNYRDDNSLIEEQSGNDLARLKLAIKYRQKEFVAQPNCQQLLASRWYDEFPGWRRRHWAVK

SEQ ID NO: 662 - protein, 86 aa, Artificial Sequence
  Description of Artificial Sequence: Synthetic polypeptide
VRKKQKAQHRCMRRVGRTGSRRSGYAFSHQEGFGELIMSGKNMRLSSLALSSFTTRSSSSWIESLRRKKSDSASSPSGGADKPLKG

SEQ ID NO: 663 - protein, 86 aa, Artificial Sequence
  Description of Artificial Sequence: Synthetic polypeptide
LLKLMFVNPPELPEQTTKALPVRFLFTDYNRLSSVGGETSLAEMIATLSDACEREFGFLATRLFRVFKTEDTQGKKKWKKTCCLPS

SEQ ID NO: 664 - protein, 86 aa, Artificial Sequence
  Description of Artificial Sequence: Synthetic polypeptide
PPYLGKLDVSFQRACQCEGKDNRIPLLKEVFEAFPNTPINIDIKVNNNVLIKKVSELVKRYNREHLTVWGNANYEIVEKCYKENSD

SEQ ID NO: 665 - protein, 86 aa, Artificial Sequence
  Description of Artificial Sequence: Synthetic polypeptide
VVAAMQARHAHVPQLRWETMDVRKLDFPSASFDVVLEKGTLDALLAGERDPWTVSSEGVHTVDQVLSEVGFQKGTRQLLGSRTQLE

SEQ ID NO: 666 - protein, 86 aa, Artificial Sequence
  Description of Artificial Sequence: Synthetic polypeptide
SAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 667 - protein, 86 aa, Artificial Sequence
  Description of Artificial Sequence: Synthetic polypeptide
AERVKELPSAGLVHYNFCTLPKRQFAPSYESRRQNQDRINKTVLYGTPRKCFVGQSKPNHPLLQAKPQSEPDYLEVLEKQTAISQL

SEQ ID NO: 668 - protein, 59 aa, Artificial Sequence
  Description of Artificial Sequence: Synthetic polypeptide
NLPPNPKRQQRKPKGNKNSILATEQEITYAELNLQKASQDFQGNDKTYHCKDLPSAPEK

SEQ ID NO: 669 - protein, 88 aa, Artificial Sequence
  Description of Artificial Sequence: Synthetic polypeptide
EKPESRTSIHNFMAHPEFRIEDSQPHIPLIDDTDLEEDAALKQNSSPPSSLNKNNSAIDSGINLTTDTSKSATSSSPGSPIHSLETSL

SEQ ID NO: 670 - protein, 88 aa, Artificial Sequence
  Description of Artificial Sequence: Synthetic polypeptide
EKPESRSSIHNFMTHPEFRIEDSEPHIPLIDDTDAEDDAPTKRNSSPPPSPNKNNNAVDSGIHLTIEMNKSATSSSPGSPLHSLETSL

SEQ ID NO: 671 - protein, 88 aa, Artificial Sequence
  Description of Artificial Sequence: Synthetic polypeptide
QGDPQRSPSSCNDLYATVKDFEKTPNSTLPPAGRPSEEPEPDYEAIQTLNREEEKATLGTNGHHGLVPKENDYESISDLQQGRDITRL

SEQ ID NO: 672 - protein, 89 aa, Artificial Sequence
  Description of Artificial Sequence: Synthetic polypeptide
KVAMIEPGYFKTAVTSKERFLKSFLEIWDRSSPEVKEAYGEKFVADYKKSAEQMEQKCTQDLSLVTNCMEHALIACHPRTRYSAGWDAK

SEQ ID NO: 673 - protein, 91 aa, Artificial Sequence
  Description of Artificial Sequence: Synthetic polypeptide
EKPESKTSIHNFMATPEFLINDYTHNIPLIDDTDVDENEERLRAPPPPSPNQNNNAIDSGIYLTTHVTKSATSSVFSSSPGSPLHSVETSL

SEQ ID NO: 674 - protein, 91 aa, Artificial Sequence
  Description of Artificial Sequence: Synthetic polypeptide
PAAPLAGPALPARRLSRASRPLSASQPSLPHGAPGPAASTRPASSSTPRLGPTPAARAAAPSPDRRDSASPGAAGGLDPQDSARSRLSSNL

SEQ ID NO: 675 - protein, 92 aa, Artificial Sequence
  Description of Artificial Sequence: Synthetic polypeptide
SKHFRKGFRTICAGLLGRAPGRASGRVCAAARGTHSGSVLERESSDLLHMSEAAGALRPCPGASQPCILEPCPGPSWQGPKAGDSILTVDVA

SEQ ID NO: 676 - protein, 92 aa, Artificial Sequence
  Description of Artificial Sequence: Synthetic polypeptide
SNAKIAYKQNKANTAQEQQYGSHEENLPADLEALQREIRMAQERLDLAVQAYSHQNNPHGPREKKAKVGSKAGSNKSTASSKSGDGKTSVWI

SEQ ID NO: 677 - protein, 94 aa, Artificial Sequence
  Description of Artificial Sequence: Synthetic polypeptide
QNEEESGEPEQAAGDAPPPYSSISAESAAYFDYKDESGFPKPPSYNVATTLPSYDEAERTKAEATIPLVPGRDEDFVGRDDFDDADQLRIGNDG

SEQ ID NO: 678 - protein, 94 aa, Artificial Sequence
  Description of Artificial Sequence: Synthetic polypeptide
EGDPQTQLQDDKDPMLILRGRVPEGRALDSEVDPDPEGDLGVRGPVFGEPSAPPHTSGVSLGESRSSEVDVSDLGSRNYSARTDFYCLVSKDDM

SEQ ID NO: 679 - protein, 95 aa, Artificial Sequence
  Description of Artificial Sequence: Synthetic polypeptide
LLGDFLRACFVRFMNYCWCWDLEAGFPSYAEFDISGNVLGLIFNQGMIWMGSFYAPGLVGINVLRLLTSMYFQCWAVMSSNVPHERVFKASRSNN

SEQ ID NO: 680 - protein, 96 aa, Artificial Sequence
  Description of Artificial Sequence: Synthetic polypeptide
TIEPVQQAGCSATRLPGDGQTSAGDASLQDPPSYPPVQVIRARVSSGSSSEVSSINSDLEWDPEDVNLEGSKENVELLGSQVHQDSVRTAHLSDDD

SEQ ID NO: 681 - protein, 96 aa, Artificial Sequence
  Description of Artificial Sequence: Synthetic polypeptide
RRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 682 - protein, 99 aa, Artificial Sequence
  Description of Artificial Sequence: Synthetic polypeptide
VKAFHSSLHESIQKPYNQKSIHSFMTHPEFAIEEELPRTPLLDEEEEENPDKASKFGTRVLLLDGEVTPYANTNNNAVDCNQVQLPQSDSSLQSLETSV

SEQ ID NO: 683 - protein, 72 aa, Artificial Sequence
  Description of Artificial Sequence: Synthetic polypeptide
NLPKGKKPAPQAAEPNNHTEYASIQTSPQPASEDTLTYADLDMVHLNRTPKQPAPKPEPSFSEYASVQVPRK

SEQ ID NO: 684 - protein, 82 aa, Artificial Sequence
  Description of Artificial Sequence: Synthetic polypeptide
TLQLAGTSPQKATTKLSSAQVDQVEVEYVTMASLPKEDISYASLTLGAEDQEPTYCNMGHLSSHLPGRGPEEPTEYSTISRP

SEQ ID NO: 685 - protein, 311 aa, Artificial Sequence
  Description of Artificial Sequence: Synthetic polypeptide
ETGPKHIPLQTLLKFMVDIALGMEYLSNRNFLHRDLAARNCMLRDDMTVCVADFGLSKKIYSGDYYRQGRIAKMPVKWIAIESLADRVYTSKSDVWAFGVTMWEIATRGMTPYPGVQNHEMYDYLLHGHRLKQPEDCLDELYEIMYSCWRTDPLDRPTFSVLRLQLEKLLESLPDVRNQADVIYVNTQLLESSEGLAQGSTLAPLDLNIDPDSIIASCTPRAAISVVTAEVHDSKPHEGRYILNGGSEEWEDLTSAPSAAVTAEKNSVLPGERLVRNGVSWSHSSMLPLGSSLPDELLFADDSSEGSEVLM

SEQ ID NO: 686 - protein, 7 aa, Artificial Sequence
  Description of Artificial Sequence: Synthetic peptide
KEEEMAD

SEQ ID NO: 687 - protein, 12 aa, Artificial Sequence
  Description of Artificial Sequence: Synthetic peptide
NFHGMNPSKDTS

SEQ ID NO: 688 - protein, 14 aa, Artificial Sequence
  Description of Artificial Sequence: Synthetic peptide
HFHKVQPQEPKVTD

SEQ ID NO: 689 - protein, 15 aa, Artificial Sequence
  Description of Artificial Sequence: Synthetic peptide
ELIKPHRAAKGAPTS

SEQ ID NO: 690 - protein, 17 aa, Artificial Sequence
  Description of Artificial Sequence: Synthetic peptide
SFQMVKPWDSRGQEATD

SEQ ID NO: 691 - protein, 17 aa, Artificial Sequence
  Description of Artificial Sequence: Synthetic peptide
QVSSAESHKDLGKKDTE

SEQ ID NO: 692 - protein, 18 aa, Artificial Sequence
  Description of Artificial Sequence: Synthetic peptide
SFSEMKSREPKDQEAPST

SEQ ID NO: 693 - protein, 18 aa, Artificial Sequence
  Description of Artificial Sequence: Synthetic peptide
SFQGLRLWEPADQEAPST

SEQ ID NO: 694 - protein, 18 aa, Artificial Sequence
  Description of Artificial Sequence: Synthetic peptide
NLPKGKKPAPQAAEPNNH

SEQ ID NO: 695 - protein, 19 aa, Artificial Sequence
  Description of Artificial Sequence: Synthetic peptide
NHSVIGPNSRLARNVKEAP

SEQ ID NO: 696 - protein, 19 aa, Artificial Sequence
  Description of Artificial Sequence: Synthetic peptide
DFQWREKTPEPPVPCVPEQ

SEQ ID NO: 697 - protein, 20 aa, Artificial Sequence
  Description of Artificial Sequence: Synthetic peptide
DHLALSRPRRLSTADPADAS

SEQ ID NO: 698 - protein, 29 aa, Artificial Sequence
  Description of Artificial Sequence: Synthetic peptide
SPTNNTVYASVTHSNRETEIWTPRENDTI

SEQ ID NO: 699 - protein, 42 aa, Artificial Sequence
  Description of Artificial Sequence: Synthetic polypeptide
DGLRDRRSFHGPYTVQAGLPLNPMGRTGLRGRGSLSCFGPNH

SEQ ID NO: 700 - protein, 55 aa, Artificial Sequence
  Description of Artificial Sequence: Synthetic polypeptide
MRIKMCLIKLCKSKAKSCENDLEMGMLNSKFKKTRYQAGMRNSENLTANNTLSKP

SEQ ID NO: 701 - protein, 57 aa, Artificial Sequence
  Description of Artificial Sequence: Synthetic polypeptide
QDLKGDDTAVRDAHSKRDTKCQPQGSSGEEKGTPTTLRGGEASERKRPDSGCSTSKD

SEQ ID NO: 702 - protein, 69 aa, Artificial Sequence
  Description of Artificial Sequence: Synthetic polypeptide
KQQMEKGPIDAITGEARYSLSEDKLIRQQIDYKTLTLHCVCPENEGSAQVPVKVLNCDSITQAKDKLLD

SEQ ID NO: 703 - protein, 73 aa, Artificial Sequence
  Description of Artificial Sequence: Synthetic polypeptide
TLQLAGTSPQKATTKLSSAQVDQVEVEYVTMASLPKEDISYASLTLGAEDQEPTYCNMGHLSSHLPGRGPEEP

SEQ ID NO: 704 - protein, 95 aa, Artificial Sequence
  Description of Artificial Sequence: Synthetic polypeptide
EDDSDVEWKFARSKLWLSYFDDGKTLPPPFSLVPSPKSFVYFIMRIVNFPKCRRRRLQKDIEMGMGNSKSRLNLFTQSNSRVFESHSFNSILNQP

SEQ ID NO: 705 - protein, 100 aa, Artificial Sequence
  Description of Artificial Sequence: Synthetic polypeptide
RKVPSFTFTPTVTYQRGGEAVSSGGRPGLLNISEPAAQPWLADTWPNTGNNHNDCSISCCTAGNGNSDSNLTTYSRPADCIANYNNQLDNKQTNLMLPES

SEQ ID NO: 706 - protein, 110 aa, Artificial Sequence
  Description of Artificial Sequence: Synthetic polypeptide
GDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQ

SEQ ID NO: 707 - protein, 110 aa, Artificial Sequence
  Description of Artificial Sequence: Synthetic polypeptide
ETGPKHIPLQTLLKFMVDIALGMEYLSNRNFLHRDLAARNCMLRDDMTVCVADFGLSKKIYSGDYYRQGRIAKMPVKWIAIESLADRVYTSKSDVWAFGVTMWEIATRGM

SEQ ID NO: 708 - protein, 113 aa, Artificial Sequence
  Description of Artificial Sequence: Synthetic polypeptide
FEFCDLGDLKAYLRSEQEHMRGDSQTMLLQRMACEVAAGLAAMHKLHFLHSDLALRNCFLTSDLNVKVGDYGIGFSRYKEDYIETDDKKVFPLRWTAPELVTSFQDRLLTADQ

SEQ ID NO: 709 - protein, 142 aa, Artificial Sequence
  Description of Artificial Sequence: Synthetic polypeptide
LEAPVGREARKWLQLAVFCSPLVPGQSHLQLRIYFLNNTPCALQWALTNEQPHGGRLRGPCQLFDFNGARGDQCLKLTYISEGWENVDDSSCQLVPHLHIWHGKCPFRSFCFRRKAADENEDCSALTNEIIVTMHTFQDGLE

SEQ ID NO: 710 - protein, 146 aa, Artificial Sequence
  Description of Artificial Sequence: Synthetic polypeptide
QRSLYDRPASYKKKSMLDSEVKNLLSDDNSEGLTLLDLLSFTYQVARGMEFLASKNCVHRDLAARNVLLAQGKIVKICDFGLARDIMHDSNYVSKGSTFLPVKWMAPESIFDNLYTTLSDVWSYGILLWEIFSLGGTPYPGMMVDS

SEQ ID NO: 711 - protein, 152 aa, Artificial Sequence
  Description of Artificial Sequence: Synthetic polypeptide
KECAGEPLFSLFCAIKQQMEKGPIDAITGEARYSLSEDKLIRQQIDYKTLVLSCVSPDNANSPEVPVKILNCDTITQVKEKILDAIFKNVPCSHRPKAADMDLEWRQGSGARMILQDEDITTKIENDWKRLNTLAHYQVPDGSVVALVSKQV

SEQ ID NO: 712 - protein, 204 aa, Artificial Sequence
  Description of Artificial Sequence: Synthetic polypeptide
TVTESYTTSDTLKPSVHVHDNRPASNVVVTERVVGPISGADLHGMLEMPDLRDGSNVIVTERVIAPSSSLPTSLTIHHPRESSNVVVTERVIQPTSGMIGSLSMHPELANAHNVIVTERVVSGAGVTGISGTTGISGGIGSSGLVGTSMGAGSGALSGAGISGGGIGLSSLGGTASIGHMRSSSDHHFNQTIGSASPSTARSRI

SEQ ID NO: 713 - protein, 213 aa, Artificial Sequence
  Description of Artificial Sequence: Synthetic polypeptide
NPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVF

SEQ ID NO: 714 - protein, 351 aa, Artificial Sequence
  Description of Artificial Sequence: Synthetic polypeptide
GGAYVGPTQNRILRLSKELGIETYKVNVSERLVQYVKGKTYPFRGAFPPVWNPIAYLDYNNLWRTIDNMGKEIPTDAPWEAQHADKWDKMTMKELIDKICWTKTARRFAYLFVNINVTSEPHEVSALWFLWYVKQCGGTTRIFSVTNGGQERKFVGGSGQVSERIMDLLGDQVKLNHPVTHVDQSSDNIIIETLNHEHYECKYVINAIPPTLTAKIHFRPELPAERNQLIQRLPMGAVIKCMMYYKEAFWKKKDYCGCMIIEDEDAPISITLDDTKPDGSLPAIMGFILARKADRLAKLHKEIRKKKICELYAKVLGSQEALHPVHYEEKNWCEEQYSGGCYTAYFPPGIM

SEQ ID NO: 715 - protein, 351 aa, Artificial Sequence
  Description of Artificial Sequence: Synthetic polypeptide
GGSYVGPTQNRILRLAKELGLETYKVNEVERLIHHVKGKSYPFRGPFPPVWNPITYLDHNNFWRTMDDMGREIPSDAPWKAPLAEEWDNMTMKELLDKLCWTESAKQLATLFVNLCVTAETHEVSALWFLWYVKQCGGTTRIISTTNGGQERKFVGGSGQVSERIMDLLGDRVKLERPVIYIDQTRENVLVETLNHEMYEAKYVISAIPPTLGMKIHFNPPLPMMRNQMITRVPLGSVIKCIVYYKEPFWRKKDYCGTMIIDGEEAPVAYTLDDTKPEGNYAAIMGFILAHKARKLARLTKEERLKKLCELYAKVLGSLEALEPVHYEEKNWCEEQYSGGCYTTYFPPGIL

SEQ ID NO: 716 - protein, 755 aa, Artificial Sequence
  Description of Artificial Sequence: Synthetic polypeptide
KGKKFIVVCGNITVDSVTAFLRNFLRDKSGEINTEIVFLGETPPSLELETIFKCYLAYTTFISGSAMKWEDLRRVAVESAEACLIIANPLCSDSHAEDISNIMRVLSIKNYDSTTRIIIQILQSHNKVYLPKIPSWNWDTGDNIICFAELKLGFIAQGCLVPGLCTFLTSLFVEQNKKVMPKQTWKKHFLNSMKNKILTQRLSDDFAGMSFPEVARLCFLKMHLLLIAIEYKSLFTDGFCGLILNPPPQVRIRKNTLGFFIAETPKDVRRALFYCSVCHDDVFIPELITNCGCKSRSRQHITVPSVKRMKKCLKGISSRISGQDSPPRVSASTSSISNFTTRTLQHDVEQDSDQLDSSGMFHWCKPTSLDKVTLKRTGKSKYKFRNHIVACVFGDAHSAPMGLRNFVMPLRASNYTRKELKDIVFIGSLDYLQREWRFLWNFPQIYILPGCALYSGDLHAANIEQCSMCAVLSPPPQPSSNQTLVDTEAIMATLTIGSLQIDSSSDPSPSVSEETPGYTNGHNEKSNCRKVPILTELKNPSNIHFIEQLGGLEGSLQETNLHLSTAFSTGTVFSGSFLDSLLATAFYNYHVLELLQMLVTGGVSSQLEQHLDKDKVYGVADSCTSLLSGRNRCKLGLLSLHETILSDVNPRNTFGQLFCGSLDLFGILCVGLYRIIDEEELNPENKRFVITRPANEFKLLPSDLVFCAIPFSTACYKRNEEFSLQKSYEIVNKASQTTETHSDTNCPPTIDSVTE

SEQ ID NO: 717 - protein, 905 aa, Artificial Sequence
  Description of Artificial Sequence: Synthetic polypeptide
ASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTT

SEQ ID NO: 718 - protein, 5 aa, Artificial Sequence
  Description of Artificial Sequence: Synthetic peptide
NLMSY

SEQ ID NO: 719 - protein, 6 aa, Artificial Sequence
  Description of Artificial Sequence: Synthetic peptide
SRFKRQ

SEQ ID NO: 720 - protein, 7 aa, Artificial Sequence
  Description of Artificial Sequence: Synthetic peptide
MDDSDTP

SEQ ID NO: 721 - protein, 7 aa, Artificial Sequence
  Description of Artificial Sequence: Synthetic peptide
YGKKRNR

SEQ ID NO: 722 - protein, 7 aa, Artificial Sequence
  Description of Artificial Sequence: Synthetic peptide
KSQWIKE

SEQ ID NO: 723 - protein, 8 aa, Artificial Sequence
  Description of Artificial Sequence: Synthetic peptide
CRGLAPEE

SEQ ID NO: 724 - protein, 8 aa, Artificial Sequence
  Description of Artificial Sequence: Synthetic peptide
RLCSAMKQ

SEQ ID NO: 725 - protein, 9 aa, Artificial Sequence
  Description of Artificial Sequence: Synthetic peptide
YRKREWIKE

SEQ ID NO: 726 - protein, 11 aa, Artificial Sequence
  Description of Artificial Sequence: Synthetic peptide
RKMKRSSSEIK

SEQ ID NO: 727 - protein, 13 aa, Artificial Sequence
  Description of Artificial Sequence: Synthetic peptide
FCNMRRPAHADIK

SEQ ID NO: 728 - protein, 13 aa, Artificial Sequence
  Description of Artificial Sequence: Synthetic peptide
LRTVKRANGGELK

SEQ ID NO: 729 - protein, 14 aa, Artificial Sequence
  Description of Artificial Sequence: Synthetic peptide
MEQHVGIDVLKRDP

SEQ ID NO: 730 - protein, 14 aa, Artificial Sequence
  Description of Artificial Sequence: Synthetic peptide
LEQHVDPHVLQNKP

SEQ ID NO: 731 - protein, 14 aa, Artificial Sequence
  Description of Artificial Sequence: Synthetic peptide
RNKDVKDAIRKIIN

SEQ ID NO: 732 - protein, 15 aa, Artificial Sequence
  Description of Artificial Sequence: Synthetic peptide
VDFRPPPQGPSGPEV

SEQ ID NO: 733 - protein, 16 aa, Artificial Sequence
  Description of Artificial Sequence: Synthetic peptide
DRYFALVQPFRLTRWR

SEQ ID NO: 734 - protein, 17 aa, Artificial Sequence
  Description of Artificial Sequence: Synthetic peptide
VRMTSEIETNIVAVERI

SEQ ID NO: 735 - protein, 20 aa, Artificial Sequence
  Description of Artificial Sequence: Synthetic peptide
MERLWGLFQRAQQLSPRSSQ

SEQ ID NO: 736 - protein, 26 aa, Artificial Sequence
  Description of Artificial Sequence: Synthetic peptide
MAEPQAESEPLLGGARGGGGDWPAGL

SEQ ID NO: 737 - protein, 27 aa, Artificial Sequence
  Description of Artificial Sequence: Synthetic peptide
PETKGVALPETMKDAENLGRKAKPKEN

SEQ ID NO: 738 - protein, 27 aa, Artificial Sequence
  Description of Artificial Sequence: Synthetic peptide
MEDEAVLDRGASFLKHVCDEEEVEGHH

SEQ ID NO: 739 - protein, 35 aa, Artificial Sequence
  Description of Artificial Sequence: Synthetic polypeptide
YKMYGSEMLHKRDPLDEDEDTDISYKKLKEEEMAD

SEQ ID NO: 740 - protein, 49 aa, Artificial Sequence
  Description of Artificial Sequence: Synthetic polypeptide
RHVSDLHGLTELILLPPPCPASFNADEDDRVDILGPQPESHQQLSASSH

SEQ ID NO: 741 - protein, 54 aa, Artificial Sequence
  Description of Artificial Sequence: Synthetic polypeptide
CSRAARGTIGARRTGQPLKEDPSAVPVFSVDYGELDFQWREKTPEPPVPCVPEQ

SEQ ID NO: 742 - protein, 55 aa, Artificial Sequence
  Description of Artificial Sequence: Synthetic polypeptide
RRKSIKKKRALRRFLETELVEPLTPSGTAPNQAQLRILKETELKRVKVLGSGAFG

SEQ ID NO: 743 - protein, 56 aa, Artificial Sequence
  Description of Artificial Sequence: Synthetic polypeptide
RIRQKKAQGSTSSTRLHEPEKNAREITQDTNDITYADLNLPKGKKPAPQAAEPNNH

SEQ ID NO: 744 - protein, 57 aa, Artificial Sequence
  Description of Artificial Sequence: Synthetic polypeptide
AVTISLAYSVKKMMKDNNLVRHLDACETMGNATAICSDKTGTLTTNRMTVVQSYLGD

SEQ ID NO: 745 - protein, 57 aa, Artificial Sequence
  Description of Artificial Sequence: Synthetic polypeptide
CCRKKRREEKYEKEVHHDIREDVPPPKSRTSTARSYIGSNHSSLGSMSPSNMEGYSK

SEQ ID NO: 746 - protein, 57 aa, Artificial Sequence
  Description of Artificial Sequence: Synthetic polypeptide
KRRQQKIRKYTMRRLLQETELVEPLTPSGAMPNQAQMRILKETELRKVKVLGSGAFG

SEQ ID NO: 747 - protein, 61 aa, Artificial Sequence
  Description of Artificial Sequence: Synthetic polypeptide
KYLQKPMYEVQWKVVEEINGNNYVYIDPTQLPYDHKWEFPRNRLSFGKTLGAGAFGKVVEA

SEQ ID NO: 748 - protein, 64 aa, Artificial Sequence
  Description of Artificial Sequence: Synthetic polypeptide
YTTYPLLKESALILLQTVPKQIDIRNLIKELRNVEGVEEVHELHVWQLAGSRIIATAHIKCEDP

SEQ ID NO: 749 - protein, 70 aa, Artificial Sequence
  Description of Artificial Sequence: Synthetic polypeptide
AANAIAQSCQPSFYDGTIIVKKLPYLPRILGRNIGSHHVRVEHFMNHSITTLAKDTPLEEVVKVVTSTDV

SEQ ID NO: 750 - protein, 71 aa, Artificial Sequence
  Description of Artificial Sequence: Synthetic polypeptide
WLHRRLPPQPIRPLPRFAPLVKTEPQRPVKEEEPKIPGDLDQEPSLLYADLDHLALSRPRRLSTADPADAS

SEQ ID NO: 751 - protein, 72 aa, Artificial Sequence
  Description of Artificial Sequence: Synthetic polypeptide
KKYQPYKVIKQKLEGRPETEYRKAQTFSGHEDALDDFGIYEFVAFPDVSGVSRIPSRSVPASDCVSGQDLHS

SEQ ID NO: 752 - protein, 72 aa, Artificial Sequence
  Description of Artificial Sequence: Synthetic polypeptide
MDEINNKIEEEKLVKANITLWEANMIKAYNASFSENSTGPPFFVHPADVPRGPCWETMVGQEFVRLTVSDVL

SEQ ID NO: 753 - protein, 73 aa, Artificial Sequence
  Description of Artificial Sequence: Synthetic polypeptide
KTHRRKAARTAVGRNDTHPTTGSASPKHQKKSKLHGPTETSSCSGAAPTVEMDEELHYASLNFHGMNPSKDTS

SEQ ID NO: 754 - protein, 75 aa, Artificial Sequence
  Description of Artificial Sequence: Synthetic polypeptide
RVKTRRKKAAQPVQNTDDVNPVMVSGSRGHQHQFQTGIVSDHPAEAGPISEDEQELHYAVLHFHKVQPQEPKVTD

SEQ ID NO: 755 - protein, 79 aa, Artificial Sequence
  Description of Artificial Sequence: Synthetic polypeptide
IVLRRRRKRVNTKRSSRAFRAHLRAPLKGNCTHPEDMKLCTVIMKSNGSFPVNRRRVEAARRAQELEMEMLSSTSPPER

SEQ ID NO: 756 - protein, 79 aa, Artificial Sequence
  Description of Artificial Sequence: Synthetic polypeptide
KARRKQAAGRPEKMDDEDPIMGTITSGSRKKPWPDSPGDQASPPGDAPPLEEQKELHYASLSFSEMKSREPKDQEAPST

SEQ ID NO: 757 - protein, 81 aa, Artificial Sequence
  Description of Artificial Sequence: Synthetic polypeptide
KICRKEARKRAAAEQDVPSTLGPISQGHQHECSAGSSQDHPPPGAATYTPGKGEEQELHYASLSFQGLRLWEPADQEAPST

SEQ ID NO: 758 - protein, 84 aa, Artificial Sequence
  Description of Artificial Sequence: Synthetic polypeptide
QRVVCQRYAGANGPFPHEYVSGTPHVPLNFIAPGGSQHGPFTGIACGKSMMSSVSLMGGRGGVPLYDRNHVTGASSSSSSSTKA

SEQ ID NO: 759 - protein, 84 aa, Artificial Sequence
  Description of Artificial Sequence: Synthetic polypeptide
VRSCRKKSARPAAGVGDTGIEDANAVRGSASQGPLTEPWAEDSPPDQPPPASARSSVGEGELQYASLSFQMVKPWDSRGQEATD

SEQ ID NO: 760 - protein, 86 aa, Artificial Sequence
  Description of Artificial Sequence: Synthetic polypeptide
FVAKIARPKNRAFSIRFTDTAVVAHMDGKPNLIFQVANTRPSPLTSVRVSAVLYQERENGKLYQTSVDFHLDGISSDECPFFIFPL

SEQ ID NO: 761 - protein, 66 aa, Artificial Sequence
  Description of Artificial Sequence: Synthetic polypeptide
QLRRRGKTNHYQTTVEKKSLTIYAQVQKPGPLQKKLDSFPAQDPCTTIYVAATEPVPESVQETNSI

SEQ ID NO: 762 - protein, 89 aa, Artificial Sequence
  Description of Artificial Sequence: Synthetic polypeptide
ILAKISRPKKRAKTITFSKNAVISKRGGKLCLLIRVANLRKSLLIGSHIYGKLLKTTVTPEGETIILDQININFVVDAGNENLFFISPL

SEQ ID NO: 763 - protein, 89 aa, Artificial Sequence
  Description of Artificial Sequence: Synthetic polypeptide
FLAKIARPKKRAETIRFSQHAVVASHNGKPCLMIRVANMRKSLLIGCQVTGKLLQTHQTKEGENIRLNQVNVTFQVDTASDSPFLILPL

SEQ ID NO: 764 - protein, 54 aa, Artificial Sequence
  Description of Artificial Sequence: Synthetic polypeptide
WFLKRERQEEYIEEKKRVDICRETPNICPHSGENTEYDTIPHTNRTILKEDPAN

SEQ ID NO: 765 - protein, 90 aa, Artificial Sequence
  Description of Artificial Sequence: Synthetic polypeptide
KCYFLRKAKAKQMPVEMSRPAVPLLNSNNEKMSDPNMEANSHYGHNDDVRNHAMKPINDNKEPLNSDVQYTEVQVSSAESHKDLGKKDTE

SEQ ID NO: 766 - protein, 59 aa, Artificial Sequence
  Description of Artificial Sequence: Synthetic polypeptide
LRKRRDSLSLSTQRTQGPAESARNLEYVSVSPTNNTVYASVTHSNRETEIWTPRENDTI

SEQ ID NO: 767 - protein, 67 aa, Artificial Sequence
  Description of Artificial Sequence: Synthetic polypeptide
RLFKRRQGRIFPEGSCLNTFTKNPYAASKKTIYTYIMASRNTQPAESRIYDEILQSKVLPSKEEPVN

SEQ ID NO: 768 - protein, 101 aa, Artificial Sequence
  Description of Artificial Sequence: Synthetic polypeptide
RRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAP

SEQ ID NO: 769 - protein, 102 aa, Artificial Sequence
  Description of Artificial Sequence: Synthetic polypeptide
KYRHKRFAVSEQGNIPHSHDWVWLGNEVELLENPVDITLPSEECTTMIDRGLQFEERNFLLNGSSQKTFHSQLLRPSDYVYEKEIKNEPMNSSGPKRKRVKF

SEQ ID NO: 770 - protein, 102 aa, Artificial Sequence
  Description of Artificial Sequence: Synthetic polypeptide
NSSYQEIEDDSDVEWKFARSKLWLSYFDDGKTLPPPFSLVPSPKSFVYFIMRIVNFPKCRRRRLQKDIEMGMGNSKSRLNLFTQSNSRVFESHSFNSILNQP

SEQ ID NO: 771 - protein, 104 aa, Artificial Sequence
  Description of Artificial Sequence: Synthetic polypeptide
WRMMKYQQKAAGMSPEQVLQPLEGDLCYADLTLQLAGTSPQKATTKLSSAQVDQVEVEYVTMASLPKEDISYASLTLGAEDQEPTYCNMGHLSSHLPGRGPEEP

SEQ ID NO: 772 - protein, 105 aa, Artificial Sequence
  Description of Artificial Sequence: Synthetic polypeptide
NNSYQEIEEDADVEWKFARAKLWLSYFDEGRTLPAPFNLVPSPKSFYYLIMRIKMCLIKLCKSKAKSCENDLEMGMLNSKFKKTRYQAGMRNSENLTANNTLSKP

SEQ ID NO: 773 - protein, 106 aa, Artificial Sequence
  Description of Artificial Sequence: Synthetic polypeptide
QSVFNKRKSRVRHYLVKCPQNSSGETVTSVTSLAPLQPKKGKRQKEKPDIPPAVPAKAPIAPTFHKPKLLKPQRKVTLPKIAEENLTYAELELIKPHRAAKGAPTS

SEQ ID NO: 774 - protein, 117 aa, Artificial Sequence
  Description of Artificial Sequence: Synthetic polypeptide
YRHRKKRNGLTSTYAGIRKVPSFTFTPTVTYQRGGEAVSSGGRPGLLNISEPAAQPWLADTWPNTGNNHNDCSISCCTAGNGNSDSNLTTYSRPADCIANYNNQLDNKQTNLMLPES

SEQ ID NO: 775 - protein, 123 aa, Artificial Sequence
  Description of Artificial Sequence: Synthetic polypeptide
RYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPA

SEQ ID NO: 776 - protein, 133 aa, Artificial Sequence
  Description of Artificial Sequence: Synthetic polypeptide
VRLRLQKHRPPADPCRGETETMNNLANCQREKDISVSIIGATQIKNTNKKADFHGDHSADKNGFKARYPAVDYNLVQDLKGDDTAVRDAHSKRDTKCQPQGSSGEEKGTPTTLRGGEASERKRPDSGCSTSKD

SEQ ID NO: 777 - protein, 135 aa, Artificial Sequence
  Description of Artificial Sequence: Synthetic polypeptide
RAWVVFKLSSAPRLHEQRVRDIQKQVREWKEQGSKTFMCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHIC

SEQ ID NO: 778 - protein, 148 aa, Artificial Sequence
  Description of Artificial Sequence: Synthetic polypeptide
TRDLVDDMGRHKSDRAINNRPCQILMGKSFKQKKWQDLCVGDVVCLRKDNIVPADMLLLASTEPSSLCYVETVDIDGETNLKFRQALMVTHKELATIKKMASFQGTVTCEAPNSRMHHFVGCLEWNDKKYSLDIGNLLLRGCRIRNTD

SEQ ID NO: 779 - protein, 162 aa, Artificial Sequence
  Description of Artificial Sequence: Synthetic polypeptide
VFDPLGGKMAPYSSAGPSHLDSHDSSQLLNGLKTAATSVWETRIKLLCCCIGKDDHTRVAFSSTAELFSTYFSDTDLVPSDIAAGLALLHQQQDNIRNNQEPAQVVCHAPGSSQEADLDAELENCHHYMQFAAAAYGWPLYIYRNPLTGLCRIGGDCCRSRT

SEQ ID NO: 780 - protein, 89 aa, Artificial Sequence
  Description of Artificial Sequence: Synthetic polypeptide
WRRKRKEKQSETSPKEFLTIYEDVKDLKTRRNHEQEQTFPGGGSTIYSMIQSQSSAPTSQEPAYTLYSLIQPSRKSGSRKRNHSPSFNS

SEQ ID NO: 781 - protein, 230 aa, Artificial Sequence
  Description of Artificial Sequence: Synthetic polypeptide
RKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVF

SEQ ID NO: 782 - protein, 238 aa, Artificial Sequence
  Description of Artificial Sequence: Synthetic polypeptide
NKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYS

SEQ ID NO: 783 - protein, 249 aa, Artificial Sequence
  Description of Artificial Sequence: Synthetic polypeptide
KLARHSKFGMKGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYS

SEQ ID NO: 784 - protein, 263 aa, Artificial Sequence
  Description of Artificial Sequence: Synthetic polypeptide
NCVSCCKDPEIDFKEFEDNFDDEIDFTPPAEDTPSVQSPAEVFTLSVPNISLPAPSQFQPSVEGLKSQVARHSLNYIQEIGNGWFGKVLLGEIYTGTSVARVIVKELKASANPKEQDTFLKNGEPYYILQHPNILQCVGQCVEAIPYLLVFEFCDLGDLKAYLRSEQEHMRGDSQTMLLQRMACEVAAGLAAMHKLHFLHSDLALRNCFLTSDLNVKVGDYGIGFSRYKEDYIETDDKKVFPLRWTAPELVTSFQDRLLTADQ

SEQ ID NO: 785 - protein, 271 aa, Artificial Sequence
  Description of Artificial Sequence: Synthetic polypeptide
YKRKTQDADRTLKRLQLQMDNLESRVALECKEAFAELQTDINELTNHMDEVQIPFLDYRTYAVRVLFPGIEAHPVLKELDTPPNVEKALRLFGQLLHSRAFVLTFIHTLEAQSSFSMRDRGTVASLTMVALQSRLDYATGLLKQLLADLIEKNLESKNHPKLLLRRTESVAEKMLTNWFTFLLHKFLKECAGEPLFLLYCAIKQQMEKGPIDAITGEARYSLSEDKLIRQQIDYKTLTLHCVCPENEGSAQVPVKVLNCDSITQAKDKLLD

SEQ ID NO: 786 - protein, 147 aa, Artificial Sequence
  Description of Artificial Sequence: Synthetic polypeptide
KRKGRCSVPAFCSSQAEAPADTPEPTAGHTLYSVLSQGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQGKTPVSQKEESSA

SEQ ID NO: 787 - protein, 272 aa, Artificial Sequence
  Description of Artificial Sequence: Synthetic polypeptide
KRVQETKFGNAFTEEDSELVVNYIAKKSFCRRAIELTLHSLGVSEELQNKLEDVVIDRNLLILGKILGEGEFGSVMEGNLKQEDGTSLKVAVKTMKLDNSSQREIEEFLSEAACMKDFSHPNVIRLLGVCIEMSSQGIPKPMVILPFMKYGDLHTYLLYSRLETGPKHIPLQTLLKFMVDIALGMEYLSNRNFLHRDLAARNCMLRDDMTVCVADFGLSKKIYSGDYYRQGRIAKMPVKWIAIESLADRVYTSKSDVWAFGVTMWEIATRGM

SEQ ID NO: 788 - protein, 277 aa, Artificial Sequence
  Description of Artificial Sequence: Synthetic polypeptide
SRQQRRREARGRGDASGLKRNSERKTPEGRASPAPGSGHPEGPGAHLDMNSLDRAQAAKNKGNKYFKAGKYEQAIQCYTEAISLCPTEKNVDLSTFYQNRAAAFEQLQKWKEVAQDCTKAVELNPKYVKALFRRAKAHEKLDNKKECLEDVTAVCILEGFQNQQSMLLADKVLKLLGKEKAKEKYKNREPLMPSPQFIKSYFSSFTDDIISQPMLKGEKSDEDKDKEGEALEVKENSGYLKAKQYMEEENYDKIISECSKEIDAEGKYMAEALLLRA

SEQ ID NO: 789 - protein, 280 aa, Artificial Sequence
  Description of Artificial Sequence: Synthetic polypeptide
LRKRRKETRFGQAFDSVMARGEPAVHFRAARSFNRERPERIEATLDSLGISDELKEKLEDVLIPEQQFTLGRMLGKGEFGSVREAQLKQEDGSFVKVAVKMLKADIIASSDIEEFLREAACMKEFDHPHVAKLVGVSLRSRAKGRLPIPMVILPFMKHGDLHAFLLASRIGENPFNLPLQTLIRFMVDIACGMEYLSSRNFIHRDLAARNCMLAEDMTVCVADFGLSRKIYSGDYYRQGCASKLPVKWLALESLADNLYTVQSDVWAFGVTMWEIMTRGQ

SEQ ID NO: 790 - protein, 275 aa, Artificial Sequence
  Description of Artificial Sequence: Synthetic polypeptide
HRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQ

SEQ ID NO: 791 - protein, 285 aa, Artificial Sequence
  Description of Artificial Sequence: Synthetic polypeptide
KRIELDDSISASSSSQGLSQPSTQTTQYLRADTPNNATPITSYPTLRIEKNDLRSVTLLEAKGKVKDIAISRERITLKDVLQEGTFGRIFHGILIDEKDPNKEKQAFVKTVKDQASEIQVTMMLTESCKLRGLHHRNLLPITHVCIEEGEKPMVILPYMNWGNLKLFLRQCKLVEANNPQAISQQDLVHMAIQIACGMSYLARREVIHKDLAARNCVIDDTLQVKITDNALSRDLFPMDYHCLGDNENRPVRWMALESLVNNEFSSASDVWAFGVTLWELMTLGQ

SEQ ID NO: 792 - protein, 293 aa, Artificial Sequence
  Description of Artificial Sequence: Synthetic polypeptide
NCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLK

SEQ ID NO: 793 - protein, 300 aa, Artificial Sequence
  Description of Artificial Sequence: Synthetic polypeptide
MFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTAQALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGDTLEPLSTIQYNVVDGLRDRRSFHGPYTVQAGLPLNPMGRTGLRGRGSLSCFGPNH

SEQ ID NO: 794 - protein, 344 aa, Artificial Sequence
  Description of Artificial Sequence: Synthetic polypeptide
AYKRKSRESDLTLKRLQMQMDNLESRVALECKEAFAELQTDIHELTSDLDGAGIPFLDYRTYTMRVLFPGIEDHPVLRDLEVPGYRQERVEKGLKLFAQLINNKVFLLSFIRTLESQRSFSMRDRGNVASLIMTVLQSKLEYATDVLKQLLADLIDKNLESKNHPKLLLRRTESVAEKMLTNWFTFLLYKFLKECAGEPLFSLFCAIKQQMEKGPIDAITGEARYSLSEDKLIRQQIDYKTLVLSCVSPDNANSPEVPVKILNCDTITQVKEKILDAIFKNVPCSHRPKAADMDLEWRQGSGARMILQDEDITTKIENDWKRLNTLAHYQVPDGSVVALVSKQV

SEQ ID NO: 795 - protein, 345 aa, Artificial Sequence
  Description of Artificial Sequence: Synthetic polypeptide
RWHCPRRLLGACWTLNGQEEPVSQPTPQLENEVSRQHLPATLPEMVAFYQELHTPTQGQTMVRQLMHKLLVFSAREVDHRGGCLMLQDTGISLLIPPGAVAVGRQERVSLILVWDLSDAPSLSQAQGLVSPVVACGPHGASFLKPCTLTFKHCAEQPSHARTYSSNTTLLDAKVWRPLGRPGAHASRDECRIHLSHFSLYTCVLEAPVGREARKWLQLAVFCSPLVPGQSHLQLRIYFLNNTPCALQWALTNEQPHGGRLRGPCQLFDFNGARGDQCLKLTYISEGWENVDDSSCQLVPHLHIWHGKCPFRSFCFRRKAADENEDCSALTNEIIVTMHTFQDGLE

SEQ ID NO: 796 - protein, 354 aa, Artificial Sequence
  Description of Artificial Sequence: Synthetic polypeptide
KQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSYVILSFENNGDYMDMKQADTTQYVPMLERKEVSKYSDIQRSLYDRPASYKKKSMLDSEVKNLLSDDNSEGLTLLDLLSFTYQVARGMEFLASKNCVHRDLAARNVLLAQGKIVKICDFGLARDIMHDSNYVSKGSTFLPVKWMAPESIFDNLYTTLSDVWSYGILLWEIFSLGGTPYPGMMVDS

SEQ ID NO: 797 - protein, 377 aa, Artificial Sequence
  Description of Artificial Sequence: Synthetic polypeptide
CCCKQRQPEGLGTRFAPVPEGGEGVMQSWRIEGAHPEDRDVSNICAPMTASNTQDRMDSSEIYTNTYAAGGTVEGGVSGVELNTGMGTAVGLMAAGAAGASGAARKRSSTMGTLRDYADADINMAFLDSYFSEKAYAYADEDEGRPANDCLLIYDHEGVGSPVGSIGCCSWIVDDLDESCMETLDPKFRTLAEICLNTEIEPFPSHQACIPISTDLPLLGPNYFVNESSGLTPSEVEFQEEMAASEPVVHGDIIVTETYGNADPCVQPTTIIFDPQLAPNVVVTEAVMAPVYDIQGNICVPAELADYNNVIYAERVLASPGVPDMSNSSTTEGCMGPVMSGNILVGPEIQVMQMMSPDLPIGQTVGSTSPMTSRHRV

SEQ ID NO: 798 - protein, 406 aa, Artificial Sequence
  Description of Artificial Sequence: Synthetic polypeptide
SNKCDVVVVGGGISGMAAAKLLHDSGLNVVVLEARDRVGGRTYTLRNQKVKYVDLGGSYVGPTQNRILRLAKELGLETYKVNEVERLIHHVKGKSYPFRGPFPPVWNPITYLDHNNFWRTMDDMGREIPSDAPWKAPLAEEWDNMTMKELLDKLCWTESAKQLATLFVNLCVTAETHEVSALWFLWYVKQCGGTTRIISTTNGGQERKFVGGSGQVSERIMDLLGDRVKLERPVIYIDQTRENVLVETLNHEMYEAKYVISAIPPTLGMKIHFNPPLPMMRNQMITRVPLGSVIKCIVYYKEPFWRKKDYCGTMIIDGEEAPVAYTLDDTKPEGNYAAIMGFILAHKARKLARLTKEERLKKLCELYAKVLGSLEALEPVHYEEKNWCEEQYSGGCYTTYFPPGIL

SEQ ID NO: 799 - protein, 416 aa, Artificial Sequence
  Description of Artificial Sequence: Synthetic polypeptide
MENQEKASIAGHMFDVVVIGGGISGLSAAKLLTEYGVSVLVLEARDRVGGRTYTIRNEHVDYVDVGGAYVGPTQNRILRLSKELGIETYKVNVSERLVQYVKGKTYPFRGAFPPVWNPIAYLDYNNLWRTIDNMGKEIPTDAPWEAQHADKWDKMTMKELIDKICWTKTARRFAYLFVNINVTSEPHEVSALWFLWYVKQCGGTTRIFSVTNGGQERKFVGGSGQVSERIMDLLGDQVKLNHPVTHVDQSSDNIIIETLNHEHYECKYVINAIPPTLTAKIHFRPELPAERNQLIQRLPMGAVIKCMMYYKEAFWKKKDYCGCMIIEDEDAPISITLDDTKPDGSLPAIMGFILARKADRLAKLHKEIRKKKICELYAKVLGSQEALHPVHYEEKNWCEEQYSGGCYTAYFPPGIM

SEQ ID NO: 800 - protein, 470 aa, Artificial Sequence
  Description of Artificial Sequence: Synthetic polypeptide
CCDCGGAPRSAAGFEPVPECSDGAIHSWAVEGPQPEPRDITTVIPQIPPDNANIIECIDNSGVYTNEYGGREMQDLGGGERMTGFELTEGVKTSGMPEICQEYSGTLRRNSMRECREGGLNMNFMESYFCQKAYAYADEDEGRPSNDCLLIYDIEGVGSPAGSVGCCSFIGEDLDDSFLDTLGPKFKKLADISLGKESYPDLDPSWPPQSTEPVCLPQETEPVVSGHPPISPHFGTTTVISESTYPSGPGVLHPKPILDPLGYGNVTVTESYTTSDTLKPSVHVHDNRPASNVVVTERVVGPISGADLHGMLEMPDLRDGSNVIVTERVIAPSSSLPTSLTIHHPRESSNVVVTERVIQPTSGMIGSLSMHPELANAHNVIVTERVVSGAGVTGISGTTGISGGIGSSGLVGTSMGAGSGALSGAGISGGGIGLSSLGGTASIGHMRSSSDHHFNQTIGSASPSTARSRI

SEQ ID NO: 801 - protein, 534 aa, Artificial Sequence
  Description of Artificial Sequence: Synthetic polypeptide
NLEGVMNQADAPRPLNWTIRKLCHAAFLPSVRLLKAQKSWIERAFYKRECVHIIPSTKDPHRCCCGRLIGQHVGLTPSISVLQNEKNESRLSRNDIQSEKWSISKHTQLSPTDAFGTIEFQGGGHSNKAMYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRCLPFFSLDSRLFYSFWGSCQLDSVGIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSN

SEQ ID NO: 802 - protein, 771 aa, Artificial Sequence
  Description of Artificial Sequence: Synthetic polypeptide
ELFANKRKYTSSYEALKGKKFIVVCGNITVDSVTAFLRNFLRDKSGEINTEIVFLGETPPSLELETIFKCYLAYTTFISGSAMKWEDLRRVAVESAEACLIIANPLCSDSHAEDISNIMRVLSIKNYDSTTRIIIQILQSHNKVYLPKIPSWNWDTGDNIICFAELKLGFIAQGCLVPGLCTFLTSLFVEQNKKVMPKQTWKKHFLNSMKNKILTQRLSDDFAGMSFPEVARLCFLKMHLLLIAIEYKSLFTDGFCGLILNPPPQVRIRKNTLGFFIAETPKDVRRALFYCSVCHDDVFIPELITNCGCKSRSRQHITVPSVKRMKKCLKGISSRISGQDSPPRVSASTSSISNFTTRTLQHDVEQDSDQLDSSGMFHWCKPTSLDKVTLKRTGKSKYKFRNHIVACVFGDAHSAPMGLRNFVMPLRASNYTRKELKDIVFIGSLDYLQREWRFLWNFPQIYILPGCALYSGDLHAANIEQCSMCAVLSPPPQPSSNQTLVDTEAIMATLTIGSLQIDSSSDPSPSVSEETPGYTNGHNEKSNCRKVPILTELKNPSNIHFIEQLGGLEGSLQETNLHLSTAFSTGTVFSGSFLDSLLATAFYNYHVLELLQMLVTGGVSSQLEQHLDKDKVYGVADSCTSLLSGRNRCKLGLLSLHETILSDVNPRNTFGQLFCGSLDLFGILCVGLYRIIDEEELNPENKRFVITRPANEFKLLPSDLVFCAIPFSTACYKRNEEFSLQKSYEIVNKASQTTETHSDTNCPPTIDSVTE

SEQ ID NO: 803 - protein, 813 aa, Artificial Sequence
  Description of Artificial Sequence: Synthetic polypeptide
QFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMGTVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSESQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPT

SEQ ID NO: 804 - protein, 1202 aa, Artificial Sequence
  Description of Artificial Sequence: Synthetic polypeptide
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEGACEDPHDLLATPTPELLLDWRQSAEEVIVKLRVGVGPLQLEDVDAAFTDTDCVVRFAGGQQWGGVFYAEIKSSCAKVQTRKGSLLHLTLPKKVPMLTWPSLLVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVV

SEQ ID NO: 805 - protein, 1424 aa, Artificial Sequence
  Description of Artificial Sequence: Synthetic polypeptide
MADGGEGEDEIQFLRTDDEVVLQCTATIHKEQQKLCLAAEGFGNRLCFLESTSNSKNVPPDLSICTFVLEQSLSVRALQEMLANTVEKSEGQVDVEKWKFMMKTAQGGGHRTLLYGHAILLRHSYSGMYLCCLSTSRSSTDKLAFDVGLQEDTTGEACWWTIHPASKQRSEGEKVRVGDDLILVSVSSERYLHLSYGNGSLHVDAAFQQTLWSVAPISSGSEAAQGYLIGGDVLRLLHGHMDECLTVPSGEHGEEQRRTVHYEGGAVSVHARSLWRLETLRVAWSGSHIRWGQPFRLRHVTTGKYLSLMEDKNLLLMDKEKADVKSTAFTFRSSKEKLDVGVRKEVDGMGTSEIKYGDSVCYIQHVDTGLWLTYQSVDVKSVRMGSIQRKAIMHHEGHMDDGISLSRSQHEESRTARVIRSTVFLFNRFIRGLDALSKKAKASTVDLPIESVSLSLQDLIGYFHPPDEHLEHEDKQNRLRALKNRQNLFQEEGMINLVLECIDRLHVYSSAAHFADVAGREAGESWKSILNSLYELLAALIRGNRKNCAQFSGSLDWLISRLERLEASSGILEVLHCVLVESPEALNIIKEGHIKSIISLLDKHGRNHKVLDVLCSLCVCHGVAVRSNQHLICDNLLPGRDLLLQTRLVNHVSSMRPNIFLGVSEGSAQYKKWYYELMVDHTEPFVTAEATHLRVGWASTEGYSPYPGGGEEWGGNGVGDDLFSYGFDGLHLWSGCIARTVSSPNQHLLRTDDVISCCLDLSAPSISFRINGQPVQGMFENFNIDGLFFPVVSFSAGIKVRFLLGGRHGEFKFLPPPGYAPCYEAVLPKEKLKVEHSREYKQERTYTRDLLGPTVSLTQAAFTPIPVDTSQIVLPPHLERIREKLAENIHELWVMNKIELGWQYGPVRDDNKRQHPCLVEFSKLPEQERNYNLQMSLETLKTLLALGCHVGISDEHAEDKVKKMKLPKNYQLTSGYKPAPMDLSFIKLTPSQEAMVDKLAENAHNVWARDRIRQGWTYGIQQDVKNRRNPRLVPYTLLDDRTKKSNKDSLREAVRTLLGYGYNLEAPDQDHAARAEVCSGTGERFRIFRAEKTYAVKAGRWYFEFETVTAGDMRVGWSRPGCQPDQELGSDERAFAFDGFKAQRWHQGNEHYGRSWQAGDVVGCMVDMNEHTMMFTLNGEILLDDSGSELAFKDFDVGDGFIPVCSLGVAQVGRMNFGKDVSTLKYFTICGLQEGYEPFAVNTNRDITMWLSKRLPQFLQVPSNHEHIEVTRIDGTIDSSPCLKVTQKSFGSQNSNTDIMFYRLSMPIECAEVFSKTVAGGLPGAGLFGPKNDLEDYDADSDFEVLMKTAHGHLVPDRVDKDKEATKPEFNNHKDYAQEKPSRLKQRFLLRRTKPDYSTSHSARLTEDVLADDRDDYDFLMQTS

SEQ ID NO: 806 - protein, 4 aa, Artificial Sequence
  Description of Artificial Sequence: Synthetic peptide
KIHK

SEQ ID NO: 807 - protein, 4 aa, Artificial Sequence
  Description of Artificial Sequence: Synthetic peptide
KTSK

SEQ ID NO: 808 - protein, 4 aa, Artificial Sequence
  Description of Artificial Sequence: Synthetic peptide
KIHR

SEQ ID NO: 809 - protein, 4 aa, Artificial Sequence
  Description of Artificial Sequence: Synthetic peptide
CVRS

SEQ ID NO: 810 - protein, 4 aa, Artificial Sequence
  Description of Artificial Sequence: Synthetic peptide
QYSK

SEQ ID NO: 811 - protein, 7 aa, Artificial Sequence
  Description of Artificial Sequence: Synthetic peptide
LFEENKL

SEQ ID NO: 812 - protein, 15 aa, Artificial Sequence
  Description of Artificial Sequence: Synthetic peptide
KAENIIMMETAQTSL

SEQ ID NO: 813 - protein, 16 aa, Artificial Sequence
  Description of Artificial Sequence: Synthetic peptide
YVISEEKDECVIATEV

SEQ ID NO: 814 - protein, 19 aa, Artificial Sequence
  Description of Artificial Sequence: Synthetic peptide
NHSKESKPTFSRATALDNV

SEQ ID NO: 815 - protein, 22 aa, Artificial Sequence
  Description of Artificial Sequence: Synthetic peptide
RKAVPDAVESRYSRTEGSLDGT

SEQ ID NO: 816 - protein, 27 aa, Artificial Sequence
  Description of Artificial Sequence: Synthetic peptide
KIHTGQPLRGPGFGLQLEREMSGMVPK

SEQ ID NO: 817 - protein, 37 aa, Artificial Sequence
  Description of Artificial Sequence: Synthetic polypeptide
VFPSGMGTSSPARRGSADGPRSAQPLRPEDGHCSWPL

SEQ ID NO: 818 - protein, 48 aa, Artificial Sequence
  Description of Artificial Sequence: Synthetic polypeptide
QTSPQPASEDTLTYADLDMVHLNRTPKQPAPKPEPSFSEYASVQVPRK

SEQ ID NO: 819 - protein, 60 aa, Artificial Sequence
  Description of Artificial Sequence: Synthetic polypeptide
YSYQPRTNSLSFPKQIAWNQSRTNSIISSQIPLGDNAKENERKTSDEVYDEDPFAYSEPL

SEQ ID NO: 820 - protein, 70 aa, Artificial Sequence
  Description of Artificial Sequence: Synthetic polypeptide
MKRLIKRYVLKAQVDKENDEVNEGELKEIKQDISSLRYELLEDKSQATEELAILIHKLSEKLNPSMLRCE

SEQ ID NO: 821 - protein, 75 aa, Artificial Sequence
  Description of Artificial Sequence: Synthetic polypeptide
IRQPVGRIFFAGTETATKWSGYMEGAVEAGERAAREVLNGLGKVTEKDIWVQEPESKDVPAVEITHTFWERNLPS

SEQ ID NO: 822 - protein, 76 aa, Artificial Sequence
  Description of Artificial Sequence: Synthetic polypeptide
LRQPVDRIYFAGTETATHWSGYMEGAVEAGERAAREILHAMGKIPEDEIWQSEPESVDVPAQPITTTFLERHLPSV

SEQ ID NO: 823 - protein, 79 aa, Artificial Sequence
  Description of Artificial Sequence: Synthetic polypeptide
MKRLIKRYVLKAQVDRENDEVNEGELKEIKQDISSLRYELLEEKSQATGELADLIQQLSEKFGKNLNKDHLRVNKGKDI

SEQ ID NO: 824 - protein, 83 aa, Artificial Sequence
  Description of Artificial Sequence: Synthetic polypeptide
LFYRRRNSPVERPPRAGHSEHHPDLGPAAEAAASQASRIWQELEAEEEPVPEGSGPLGPWGPQDWVGPLPRGPTTPDEGCLRY

SEQ ID NO: 825 - protein, 136 aa, Artificial Sequence
  Description of Artificial Sequence: Synthetic polypeptide
LRFQASEEESWAAPPPVSQPPPCNRLPPELFEQLRMLLEPNSITGNDWRRLASHLGLCGMKIRFLSCQRSPAAAILELFEEQNGSLQELHYLMTVMERLDCASAIQNYLSGTHGGSPGPERGGARDNQGLELDEKL

SEQ ID NO: 826 - protein, 141 aa, Artificial Sequence
  Description of Artificial Sequence: Synthetic polypeptide
ENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 827 - protein, 151 aa, Artificial Sequence
  Description of Artificial Sequence: Synthetic polypeptide
TRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 828 - protein, 172 aa, Artificial Sequence
  Description of Artificial Sequence: Synthetic polypeptide
WSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 829 - protein, 180 aa, Artificial Sequence
  Description of Artificial Sequence: Synthetic polypeptide
KSGYRMAKPDHATSEVYEIMVKCWNSEPEKRPSFYHLSEIVENLLPGQYKKSYEKIHLDFLKSDHPAVARMRVDSDNAYIGVTYKNEEDKLKDWEGGLDEQRLSADSGYIIPLPDIDPVPEEEDLGKRNRHSSQTSEESAIETGSSSSTFIKREDETIEDIDMMDDIGIDSSDLVEDSFL

SEQ ID NO: 830 - protein, 195 aa, Artificial Sequence
  Description of Artificial Sequence: Synthetic polypeptide
QNHEMYDYLLHGHRLKQPEDCLDELYEIMYSCWRTDPLDRPTFSVLRLQLEKLLESLPDVRNQADVIYVNTQLLESSEGLAQGSTLAPLDLNIDPDSIIASCTPRAAISVVTAEVHDSKPHEGRYILNGGSEEWEDLTSAPSAAVTAEKNSVLPGERLVRNGVSWSHSSMLPLGSSLPDELLFADDSSEGSEVLM

SEQ ID NO: 831 - protein, 274 aa, Artificial Sequence
  Description of Artificial Sequence: Synthetic polypeptide
CETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMS

SEQ ID NO: 832 - protein, 275 aa, Artificial Sequence
  Description of Artificial Sequence: Synthetic polypeptide
CETLQFLDCICGSTTGGLGLLGLYINEKNVALVNQNLESLTEYCQGPCHENQTCIATHESNGIDIIIALILNDINPLGKYRMDLVLQLKNNASKLLLAIMESRHDSENAERILFNMRPRELVDVMKNAYNQGLECDHGDDEGGDDGVSPKDVGHNIYILAHQLARHNKLLQQMLKPGSDPDEGDEALKYYANHTAQIEIVRHDRTMEQIVFPVPNICEYLTRESKCRVFNTTERDEQGSKVNDFFQQTEDLYNEMKWQKKIRNNPALFWFSRHIS

SEQ ID NO: 833 - protein, 286 aa, Artificial Sequence
  Description of Artificial Sequence: Synthetic polypeptide
NNSTVSRTSASKYENMIRYTGSPDSLRSRTPMITPDLESGVKMWHLVKNHEHGDQKEGDRGSKMVSEIYLTRLLATKGTLQKFVDDLFETIFSTAHRGSALPLAIKYMFDFLDEQADKHGIHDPHVRHTWKSNCLPLRFWVNMIKNPQFVFDIHKNSITDACLSVVAQTFMDSCSTSEHRLGKDSPSNKLLYAKDIPSYKNWVERYYSDIGKMPAISDQDMNAYLAEQSRMHMNEFNTMSALSEIFSYVGKYSEEILGPLDHDDQCGKQKLAYKLEQVITLMSLDS

SEQ ID NO: 834 - protein, 298 aa, Artificial Sequence
  Description of Artificial Sequence: Synthetic polypeptide
CETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMT

SEQ ID NO: 835 - protein, 353 aa, Artificial Sequence
  Description of Artificial Sequence: Synthetic polypeptide
PYSQRPKAEDMDLEWRQGRMTRIILQDEDVTTKIECDWKRLNSLAHYQVTDGSLVALVPKQVSAYNMANSFTFTRSLSRYESLLRTASSPDSLRSRAPMITPDQETGTKLWHLVKNHDHADHREGDRGSKMVSEIYLTRLLATKGTLQKFVDDLFETVFSTAHRGSALPLAIKYMFDFLDEQADQRQISDPDVRHTWKSNCLPLRFWVNVIKNPQFVFDIHKNSITDACLSVVAQTFMDSCSTSEHRLGKDSPSNKLLYAKDIPNYKSWVERYYRDIAKMASISDQDMDAYLVEQSRLHASDFSVLSALNELYFYVTKYRQEILTALDRDASCRKHKLRQKLEQIISLVSSDS

SEQ ID NO: 836 - protein, 610 aa, Artificial Sequence
  Description of Artificial Sequence: Synthetic polypeptide
DLSNKINEMKTFNSPNLKDGRFVNPSGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEETES

SEQ ID NO: 837 - protein, 4 aa, Artificial Sequence
  Description of Artificial Sequence: Synthetic peptide
KIHK

SEQ ID NO: 838 - protein, 4 aa, Artificial Sequence
  Description of Artificial Sequence: Synthetic peptide
KTSK

SEQ ID NO: 839 - protein, 4 aa, Artificial Sequence
  Description of Artificial Sequence: Synthetic peptide
KIHR

SEQ ID NO: 840 - protein, 4 aa, Artificial Sequence
  Description of Artificial Sequence: Synthetic peptide
CVRS

SEQ ID NO: 841 - protein, 4 aa, Artificial Sequence
  Description of Artificial Sequence: Synthetic peptide
QYSK

SEQ ID NO: 842 - protein, 5 aa, Artificial Sequence
  Description of Artificial Sequence: Synthetic peptide
HYTQQ

SEQ ID NO: 843 - protein, 7 aa, Artificial Sequence
  Description of Artificial Sequence: Synthetic peptide
LGPKPQG

SEQ ID NO: 844 - protein, 7 aa, Artificial Sequence
  Description of Artificial Sequence: Synthetic peptide
LFEENKL

SEQ ID NO: 845 - protein, 8 aa, Artificial Sequence
  Description of Artificial Sequence: Synthetic peptide
VKADTYCA

SEQ ID NO: 846 - protein, 8 aa, Artificial Sequence
  Description of Artificial Sequence: Synthetic peptide
QTSEPSGT

SEQ ID NO: 847 - protein, 10 aa, Artificial Sequence
  Description of Artificial Sequence: Synthetic peptide
QSCALPTDAL

SEQ ID NO: 848 - protein, 10 aa, Artificial Sequence
  Description of Artificial Sequence: Synthetic peptide
AKNALLRWRV

SEQ ID NO: 849 - protein, 10 aa, Artificial Sequence
  Description of Artificial Sequence: Synthetic peptide
SKNRLLSIKT

SEQ ID NO: 850 - protein, 12 aa, Artificial Sequence
  Description of Artificial Sequence: Synthetic peptide
QHIPAQQQDHPE

SEQ ID NO: 851 - protein, 14 aa, Artificial Sequence
  Description of Artificial Sequence: Synthetic peptide
AHHRFYTKRLTFWT

SEQ ID NO: 852 - protein, 14 aa, Artificial Sequence
  Description of Artificial Sequence: Synthetic peptide
AHHRFYAKRMTLWT

SEQ ID NO: 853 - protein, 14 aa, Artificial Sequence
  Description of Artificial Sequence: Synthetic peptide
KHRHWYPFNFVIEQ

SEQ ID NO: 854 - protein, 15 aa, Artificial Sequence
  Description of Artificial Sequence: Synthetic peptide
AHHRFYAERLAGWPC

SEQ ID NO: 855 - protein, 15 aa, Artificial Sequence
  Description of Artificial Sequence: Synthetic peptide
KAENIIMMETAQTSL

SEQ ID NO: 856 - protein, 16 aa, Artificial Sequence
  Description of Artificial Sequence: Synthetic peptide
YVISEEKDECVIATEV

SEQ ID NO: 857 - protein, 22 aa, Artificial Sequence
  Description of Artificial Sequence: Synthetic peptide
RKAVPDAVESRYSRTEGSLDGT

SEQ ID NO: 858 - protein, 27 aa, Artificial Sequence
  Description of Artificial Sequence: Synthetic peptide
KIHTGQPLRGPGFGLQLEREMSGMVPK

SEQ ID NO: 859 - protein, 30 aa, Artificial Sequence
  Description of Artificial Sequence: Synthetic polypeptide
IYAGFDTKIMKNCGKIHLKRTKLDLLMNKL

SEQ ID NO: 860 - protein, 31 aa, Artificial Sequence
  Description of Artificial Sequence: Synthetic polypeptide
ASALKSHRTRGHGRGDCCGRSLGDSCCFSAK

SEQ ID NO: 861 - protein, 36 aa, Artificial Sequence
  Description of Artificial Sequence: Synthetic polypeptide
FTLVLEEIRQGFFTDEDTHLVKKFTLYVGDNWNKCD

SEQ ID NO: 862 - protein, 37 aa, Artificial Sequence; identical to SEQ ID NO: 817
  Description of Artificial Sequence: Synthetic polypeptide

SEQ ID NO: 863 - protein, 44 aa, Artificial Sequence
  Description of Artificial Sequence: Synthetic polypeptide
PSEDFERTPQSPTLPPAKVAAPNLSRMGAIPVMIPAQSKDGSIV

SEQ ID NO: 864 - protein, 46 aa, Artificial Sequence
  Description of Artificial Sequence: Synthetic polypeptide
LPEDGGPYTNSILFDSDDNIKWVCQDMGLGDSQDFRDYMESLQDQM

SEQ ID NO: 865 - protein, 48 aa, Artificial Sequence; identical to SEQ ID NO: 818
  Description of Artificial Sequence: Synthetic polypeptide

SEQ ID NO: 866 - protein, 52 aa, Artificial Sequence
  Description of Artificial Sequence: Synthetic polypeptide
SYHASGHSVAYKPGGFKASTGFGSNTKNKKIYDGGARTEDEVQSYPSKHDYV

SEQ ID NO: 867 - protein, 52 aa, Artificial Sequence
  Description of Artificial Sequence: Synthetic polypeptide
QVGPGAAARWDLCIDQAVVFIEDAIQYRSINHRVDASSMWLYRRYYSNVCQR

SEQ ID NO: 868 - protein, 57 aa, Artificial Sequence
  Description of Artificial Sequence: Synthetic polypeptide
EGPRKGHLEEEEEDGEEGAETLAHFCPMELRGPEPLGSRPRQPNLIPWAAAGRRAAP

SEQ ID NO: 869 - protein, 51 aa, Artificial Sequence
  Description of Artificial Sequence: Synthetic polypeptide
QKPGPLQKKLDSFPAQDPCTTIYVAATEPVPESVQETNSITVYASVTLPES

SEQ ID NO: 870 - protein, 60 aa, Artificial Sequence; identical to SEQ ID NO: 819
  Description of Artificial Sequence: Synthetic polypeptide

SEQ ID NO: 871 - protein, 61 aa, Artificial Sequence
  Description of Artificial Sequence: Synthetic polypeptide
DPFEMAAYLKDGYRIAQPINCPDELFAVMACCWALDPEERPKFQQLVQCLTEFHAALGAYV

SEQ ID NO: 872 - protein, 43 aa, Artificial Sequence
  Description of Artificial Sequence: Synthetic polypeptide
THSNRETEIWTPRENDTITIYSTINHSKESKPTFSRATALDNV

SEQ ID NO: 873 - protein, 70 aa, Artificial Sequence; identical to SEQ ID NO: 820
  Description of Artificial Sequence: Synthetic polypeptide

SEQ ID NO: 874 - protein, 75 aa, Artificial Sequence
  Description of Artificial Sequence: Synthetic polypeptide
PPSHHQLTLPDPSHHGLHSTPDSPAKPEKNGHAKDHPKIAKIFEIQTMPNGKTRTSLKTMSRRKLSQQKEKKATQ

SEQ ID NO: 875 - protein, 75 aa, Artificial Sequence; identical to SEQ ID NO: 821
  Description of Artificial Sequence: Synthetic polypeptide

SEQ ID NO: 876 - protein, 49 aa, Artificial Sequence
  Description of Artificial Sequence: Synthetic polypeptide
FNLQGKTPVSQKEESSATIYCSIRKPQVVPPPQQNDLEIPESPTYENFT

SEQ ID NO: 877 - protein, 76 aa, Artificial Sequence; identical to SEQ ID NO: 822
  Description of Artificial Sequence: Synthetic polypeptide

SEQ ID NO: 878 - protein, 48 aa, Artificial Sequence
  Description of Artificial Sequence: Synthetic polypeptide
PHTNRTILKEDPANTVYSTVEIPKKMENPHSLLTMPDTPRLFAYENVI

SEQ ID NO: 879 - protein, 79 aa, Artificial Sequence; identical to SEQ ID NO: 823
  Description of Artificial Sequence: Synthetic polypeptide

SEQ ID NO: 880 - protein, 83 aa, Artificial Sequence; identical to SEQ ID NO: 824
  Description of Artificial Sequence: Synthetic polypeptide

SEQ ID NO: 881 - protein, 86 aa, Artificial Sequence
  Description of Artificial Sequence: Synthetic polypeptide
ANLTASDVMNRVNLGYLQDEMNDHQNTLSYVLINPPPDTRLEPSDIVYLIRSDPLAHVASSSQSRKSSCSHKLSSCNPETRDETQL

SEQ ID NO: 882 - protein, 63 aa, Artificial Sequence [sequence omitted]

SEQ ID NO: 883 - protein, 92 aa, Artificial Sequence
  Description of Artificial Sequence: Synthetic polypeptide
ENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 884 - protein, 95 aa, Artificial Sequence
  Description of Artificial Sequence: Synthetic polypeptide
LIGDFLRACFVRFCNYCWCWDLEYGYPSYTEFDISGNVLALIFNQGMIWMGSFFAPSLPGINILRLHTSMYFQCWAVMCCNVPEARVFKASRSNN

SEQ ID NO: 885 - protein, 105 aa, Artificial Sequence
  Description of Artificial Sequence: Synthetic polypeptide
ESTESQILVGIVQRAQLVQALQAEPPSRAPGHQQCLQDILARGCPTEPVTLTLFSETTLHQAQNLFKLLNLQSLFVTSRGRAVGCVSWVEMKKAISNLTNPPAPK

SEQ ID NO: 886 - protein, 108 aa, Artificial Sequence
  Description of Artificial Sequence: Synthetic polypeptide
AKTIKDVFHNHGIHATTIQPEFASVGSKSSVVPCELACRTQCALKQCCGTLPQAPSGKDAEKTPAVSISCLELSNNLEKKPRRTKAENIPAVVIEIKNMPNKQPESSL

SEQ ID NO: 887 - protein, 113 aa, Artificial Sequence
  Description of Artificial Sequence: Synthetic polypeptide
TPSSPLATLLQHENPSHFELVVFLSAMQEGTGEICQRRTSYLPSEIMLHHCFASLLTRGSKGEYQIKMENFDKTVPEFPTPLVSKSPNRTDLDIHINGQSIDNFQISETGLTE

SEQ ID NO: 888 - protein, 113 aa, Artificial Sequence
  Description of Artificial Sequence: Synthetic polypeptide
GGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 889 - protein, 113 aa, Artificial Sequence
  Description of Artificial Sequence: Synthetic polypeptide
GGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 890 - protein, 118 aa, Artificial Sequence
  Description of Artificial Sequence: Synthetic polypeptide
LNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 891 - protein, 119 aa, Artificial Sequence
  Description of Artificial Sequence: Synthetic polypeptide
DHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 892 - protein, 120 aa, Artificial Sequence
  Description of Artificial Sequence: Synthetic polypeptide
DETSPLKDLPLRSGEGDFELVLILSGTVESTSATCQVRTSYLPEEILWGYEFTPAISLSASGKYIADFSLFDQVVKVASPSGLRDSTVRYGDPEKLKLEESLREQAEKEGSALSVRISNV

SEQ ID NO: 893 - protein, 136 aa, Artificial Sequence; identical to SEQ ID NO: 825
  Description of Artificial Sequence: Synthetic polypeptide

SEQ ID NO: 894 - protein, 151 aa, Artificial Sequence; identical to SEQ ID NO: 827
  Description of Artificial Sequence: Synthetic polypeptide

SEQ ID NO: 895 - protein, 154 aa, Artificial Sequence
  Description of Artificial Sequence: Synthetic polypeptide
ENAEIYNYLIGGNRLKQPPECMEDVYDLMYQCWSADPKQRPSFTCLRMELENILGQLSVLSASQDPLYINIERAEEPTAGGSLELPGRDQPYSGAGDGSGMGAVGGTPSDCRYILTPGGLAEQPGQAEHQPESPLNETQRLLLLQQGLLPHSSC

SEQ ID NO: 896 - protein, 172 aa, Artificial Sequence; identical to SEQ ID NO: 828
  Description of Artificial Sequence: Synthetic polypeptide

SEQ ID NO: 897 - protein, 180 aa, Artificial Sequence; identical to SEQ ID NO: 829
  Description of Artificial Sequence: Synthetic polypeptide

SEQ ID NO: 898 - protein, 195 aa, Artificial Sequence; identical to SEQ ID NO: 830
  Description of Artificial Sequence: Synthetic polypeptide

SEQ ID NO: 899 - protein, 205 aa, Artificial Sequence
  Description of Artificial Sequence: Synthetic polypeptide
PDPYKSSILSLIKFKENPHLIIMNVSDCIPDAIEVVSKPEGTKIQFLGTRKSLTETELTKPNYLYLLPTEKNHSGPGPCICFENLTYNQAASDSGSCGHVPVSPKAPSMLGLMTSPENVLKALEKNYMNSLGEIPAGETSLNYVSQLASPMFGDKDSLPTNPVEAPHCSEYKMQMAVSLRLALPPPTENSSLSSITLLDPGEHYC

SEQ ID NO: 900 - protein, 224 aa, Artificial Sequence
  Description of Artificial Sequence: Synthetic polypeptide
PNPENCKALQFQKSVCEGSSALKTLEMNPCTPNNVEVLETRSAFPKIEDTEIISPVAERPEDRSDAEPENHVVVSYCPPIIEEEIPNPAADEAGGTAQVIYIDVQSMYQPQAKPEEEQENDPVGGAGYKPQMHLPINSTVEDIAAEEDLDKTAGYRPQANVNTWNLVSPDSPRSIDSNSEIVSFGSPCSINSRQFLIPPKDEDSPKSNGGGWSFTNFFQNKPND

SEQ ID NO: 901 - protein, 230 aa, Artificial Sequence
  Description of Artificial Sequence: Synthetic polypeptide
RDVKKGNLPPDYRISLIDIGLVIEYLMGGAYRCNYTRKRFRTLYHNLFGPKRPKALKLLGMEDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRK

SEQ ID NO: 902 - protein, 96 aa, Artificial Sequence
  Description of Artificial Sequence: Synthetic polypeptide
KDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 903 - protein, 266 aa, Artificial Sequence
  Description of Artificial Sequence: Synthetic polypeptide
GNANAAKPDLDKVISLKEANVKLRANALIKRGSMYMQQQQPLLSTQDFNMAADIDPQNADVYHHRGQLKILLDQVEEAVADFDECIRLRPESALAQAQKCFALYRQAYTGNNSSQIQAAMKGFEEVIKKFPRCAEGYALYAQALTDQQQFGKADEMYDKCIDLEPDNATTYVHKGLLQLQWKQDLDRGLELISKAIEIDNKCDFAYETMGTIEVQRGNMEKAIDMFNKAINLAKSEMEMAHLYSLCDAAHAQTEVAKKYGLKPPTL

SEQ ID NO: 904 - protein, 267 aa, Artificial Sequence
  Description of Artificial Sequence: Synthetic polypeptide
ENEAPWVTDKRPPPDWPSKGKIQFNNYQVRYRPELDLVLRGITCDIGSMEKIGVVGRTGAGKSSLTNCLFRILEAAGGQIIIDGVDIASIGLHDLREKLTIIPQDPILFSGSLRMNLDPFNNYSDEEIWKALELAHLKSFVASLQLGLSHEVTEAGGNLSIGQRQLLCLGRALLRKSKILVLDEATAAVDLETDNLIQTTIQNEFAHCTVITIAHRLHTIMDSDKVMVLDNGKIIECGSPEELLQIPGPFYFMAKEAGIENVNSTKF

SEQ ID NO: 905 - protein, 274 aa, Artificial Sequence; identical to SEQ ID NO: 831
  Description of Artificial Sequence: Synthetic polypeptide

SEQ ID NO: 906 - protein, 275 aa, Artificial Sequence; identical to SEQ ID NO: 832
  Description of Artificial Sequence: Synthetic polypeptide

SEQ ID NO: 907 - protein, 286 aa, Artificial Sequence; identical to SEQ ID NO: 833
  Description of Artificial Sequence: Synthetic polypeptide

SEQ ID NO: 908 - protein, 298 aa, Artificial Sequence; identical to SEQ ID NO: 834
  Description of Artificial Sequence: Synthetic polypeptide

SEQ ID NO: 909 - protein, 323 aa, Artificial Sequence
  Description of Artificial Sequence: Synthetic polypeptide
LADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 910 - protein, 341 aa, Artificial Sequence
  Description of Artificial Sequence: Synthetic polypeptide
NPEYFSASDMYVPDEWEVPREQISIIRELGQGSFGMVYEGLARGLEAGEESTPVALKTVNELASPRECIEFLKEASVMKAFKCHHVVRLLGVVSQGQPTLVIMELMTRGDLKSHLRSLRPEAENNPGLPQPALGEMIQMAGEIADGMAYLAANKFVHRDLAARNCMVSQDFTVKIGDFGMTRDVYETDYYRKGGKGLLPVRWMAPESLKDGIFTTHSDVWSFGVVLWEIVTLAEQPYQGLSNEQVLKFVMDGGVLEELEGCPLQLQELMSRCWQPNPRLRPSFTHILDSIQEELRPSFRLLSFYYSPECRGARGSLPTTDAEPDSSPTPRDCSPQNGGPGH

SEQ ID NO: 911 - protein, 351 aa, Artificial Sequence
  Description of Artificial Sequence: Synthetic polypeptide
PAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSI

SEQ ID NO: 912 - protein, 351 aa, Artificial Sequence
  Description of Artificial Sequence: Synthetic polypeptide
GGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPEYRLVIVGHSLGGGAAALLATMLRAAYPQVRCYAFSPPRGLWSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 913 - protein, 353 aa, Artificial Sequence; identical to SEQ ID NO: 835
  Description of Artificial Sequence: Synthetic polypeptide

SEQ ID NO: 914 - protein, 364 aa, Artificial Sequence
  Description of Artificial Sequence: Synthetic polypeptide
KSDAAMTVAVKMLKPSAHLTEREALMSELKVLSYLGNHMNIVNLLGACTIGGPTLVITEYCCYGDLLNFLRRKRDSFICSKQEDHAEAALYKNLLHSKESSCSDSTNEYMDMKPGVSYVVPTKADKRRSVRIGSYIERDVTPAIMEDDELALDLEDLLSFSYQVAKGMAFLASKNCIHRDLAARNILLTHGRITKICDFGLARDIKNDSNYVVKGNARLPVKWMAPESIFNCVYTFESDVWSYGIFLWELFSLGSSPYPGMPVDSKFYKMIKEGFRMLSPEHAPAEMYDIMKTCWDADPLKRPTFKQIVQLIEKQISESTNHIYSNLANCSPNRQKPVVDHSVRINSVGSTASSSQPLLVHDDV

SEQ ID NO: 915 - protein, 435 aa, Artificial Sequence
  Description of Artificial Sequence: Synthetic polypeptide
HVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQ

SEQ ID NO: 916 - protein, 517 aa, Artificial Sequence
  Description of Artificial Sequence: Synthetic polypeptide
WIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 917 - protein, 541 aa, Artificial Sequence
  Description of Artificial Sequence: Synthetic polypeptide
IMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 918 - protein, 548 aa, Artificial Sequence
  Description of Artificial Sequence: Synthetic polypeptide
IMDPGEVPLEEQCEYLSYDASQWEFPRERLHLGRVLGYGAFGKVVEASAFGIHKGSSCDTVAVKMLKEGATASEHRALMSELKILIHIGNHLNVVNLLGACTKPQGPLMVIVEFCKYGNLSNFLRAKRDAFSPCAEKSPEQRGRFRAMVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVDNQTDSGMVLASEEFEQIESRHRQESGFSCKGPGQNVAVTRAHPDSQGRRRRPERGARGGQVFYNSEYGELSEPSEEDHCSPSARVTFFTDNSY

SEQ ID NO: 919 - protein, 552 aa, Artificial Sequence
  Description of Artificial Sequence: Synthetic polypeptide
VMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 920 - protein, 410 aa, Artificial Sequence
  Description of Artificial Sequence: Synthetic polypeptide
FEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 921 - protein, 572 aa, Artificial Sequence
  Description of Artificial Sequence: Synthetic polypeptide
WVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 922 - protein, 610 aa, Artificial Sequence; identical to SEQ ID NO: 836
  Description of Artificial Sequence: Synthetic polypeptide

SEQ ID NO: 923 - protein, 651 aa, Artificial Sequence
  Description of Artificial Sequence: Synthetic polypeptide
EPQDGCHPGDSVERSVTCLPSASDENENQLDGDGHEHLTSSDSAMGKPQVSEQDSLNNNESCTLSCEVAAGENLQNTLCEASRDEQAFLGKDKKIPGKRSPRSKKGTAKKIPPGLFSGDIAPLMQEKVLSAVTYAVDDEEAAEVNANEQPEAPKLVLQSLFSLIRGEVEQLDSRALPLCLHQIAESYFQEEDYEKAMKFIQLERLYHEQLLANLSAIQEQWETKWKTVQPHTVTALRNSEKGFNGEDFERLTKICATHQDPLLSKHKIAAVEKSQERKCSTQLLVSEDPKEGGATTKESESKTCLGTESSKESQHTVEPLGSSPCCHQMDVQTDSPSLSVTAGKDHMEELLCSAEATLALHTQSSETAGSPSGPDSSEDACEDDSRLQLAQTEACQDVARIEGIAEDPKVFLSSKSKTEPLISPGCDRIPPALISEGKYSQAQRKELRLPLRDASEALPTDQLENNELNELQQPDLTDSDGKSPQAQADSDGSENVLCGNNQISDLGILLPEVCMAPEEKGDKDDQLNKETEDYLNSLLEGCLKDTEDSLSYEDNQDDDSDLLQDLSPEEASYSLQENLPSDESCLSLDDLAKRIEIAEVVPTEGLVSILKKRNDTVGDHPAQMQHKPSKRRVRFQEIDDSLDQDEVGGGS

SEQ ID NO: 924 - protein, 766 aa, Artificial Sequence
  Description of Artificial Sequence: Synthetic polypeptide
SKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAGGVVSPQPHSSYYSGMTGPQHPFYNRPFFAPYLYTPRYYPGGSQHLISRPSVKTSLPRDQNNGLEVIKEDAAEGLSSPTDSSRGSGPAPGPVVLLNSLNVDAVCEKLKQIEGLDQSMLPQYCTTIKKANINGRVLAQCNIDELKKEMNMNFGDWHLFRSTVLEMRNAESHVVPEDPRFLSESSSGPAPHGEPARRASHNELPHTELSSQTPYTLNFSFEELNTLGLDEGAPRHSNLSWQSQTRRTPSLSSLNSQDSSIEISKLTDKVQAEYRDAYREYIAQMSQLEGGPGSTTISGRSSPHSTYYMGQSSSGGSIHSNLEQEKGKDSEPKPDDGRKSFLMKRGDVIDYSSSGVSTNDASPLDPITEEDEKSDQSGSKLLPGKKSSERSSLFQTDLKLKGSGLRYQKLPSDEDESGTEESDNTPLLKDDKDRKAEGKVERVPKSPEHSAEPIRTFIKAKEYLSDALLDKKDSSDSGVRSSESSPNHSLHNEVADDSQLEKANLIELEDDSHSGKRGIPHSLSGLQDPIIARMSICSEDKKSPSECSLIASSPEENWPACQKAYNLNRTPSTVTLNNNSAPANRANQNFDEMEGIRETSQVILRPSSSPNPTTIQNENLKSMTHKRSQRSSYTRLSKDPPELHAAASSESTGFGEERESIL

SEQ ID NO: 925 - protein, 1171 aa, Artificial Sequence
  Description of Artificial Sequence: Synthetic polypeptide
WSLGVTLWELFDNAAQPYSNLSNLDVLNQVIRERDTKLPKPQLEQPYSDRWYEVLQFCWLSPEKRPAAEDVHRLLTYLRLQSQRDSEVDFEQQWNALKPNTNSRDSSNNAAFPILDHFARDRLGREMEEVLTVTETSQGLSFEYVWEAAKHDHFDERSRGHLDEGLSYTSIFYPVEVFESSLSDPGPGKQDDSGQDVPLRVPGVVPVFDAHNLSVGSDYYIQLEEKSGSNLELDYPPALLTTDMDNPERTGPELSQLTALRSVELEESSTDEDFFQSSTDPKDSSLPGDLHVTSGPESPFNNIFNDVDKSEDLPSHQKIFDLMELNGVQADFKPATLSSSLDNPKESVITGHFEKEKPRKIFDSEPLCLSDNLMHQDNFDPLNVQELSENFLFLQEKNLLKGSLSSKEHINDLQTELKNAGFTEAMLETSCRNSLDTELQFAENKPGLSLLQENVSTKGDDTDVMLTGDTLSTSLQSSPEVQVPPTSFETEETPRRVPPDSLPTQGETQPTCLDVIVPEDCLHQDISPDAVTVPVEILSTDARTHSLDNRSQDSPGESEETLRLTESDSVLADDILASRVSVGSSLPELGQELHNKPFSEDHHSHRRLEKNLEAVETLNQLNSKDAAKEAGLVSALSSDSTSQDSLLEDSLSAPFPASEPSLETPDSLESVDVHEALLDSLGSHTPQKLVPPDKPADSGYETENLESPEWTLHPAPEGTADSEPATTGDGGHSGLPPNPVIVISDAGDGHRGTEVTPETFTAGSQGSYRDSAYFSDNDSEPEKRSEEVPGTSPSALVLVQEQPLPEPVLPEQSPAAQDSCLEARKSQPDESCLSALHNSSDLELRATPEPAQTGVPQQVHPTEDEASSPWSVLNAELSSGDDFETQDDRPCTLASTGTNTNELLAYTNSALDKSLSSHSEGPKLKEPDIEGKYLGKLGVSGMLDLSEDGMDADEEDENSDDSDEDLRAFNLHSLSSESEDETEHPVPIILSNEDGRHLRSLLKPTAANAPDPLPEDWKKEKKAVTFFDDVTVYLFDQETPTKELGPCGGEACGPDLSGPAPASGSPYLSRCINSESSTDEEGGGFEWDDDFSPDPFMSKTTSNLLSSKPSLQTSKYFSPPPPARSTEQSWPHSAPYSRFSISPANIASFSLTHLTDSDIEQGGSSEDGEKD

SEQ ID NO: 926 - protein, 6 aa, Artificial Sequence
  Description of Artificial Sequence: Synthetic peptide
TAYELV

SEQ ID NO: 927 - protein, 6 aa, Artificial Sequence
  Description of Artificial Sequence: Synthetic peptide
TAYGLI

SEQ ID NO: 928 - protein, 6 aa, Artificial Sequence
  Description of Artificial Sequence: Synthetic peptide
TAYNAV

SEQ ID NO: 929 - protein, 6 aa, Artificial Sequence
  Description of Artificial Sequence: Synthetic peptide
TCYGLV

SEQ ID NO: 930 - protein, 6 aa, Artificial Sequence
  Description of Artificial Sequence: Synthetic peptide
TCYPDI

SEQ ID NO: 931 - protein, 6 aa, Artificial Sequence
  Description of Artificial Sequence: Synthetic peptide
TDYASI

SEQ ID NO: 932 - protein, 6 aa, Artificial Sequence
  Description of Artificial Sequence: Synthetic peptide
TDYDLV

SEQ ID NO: 933 - protein, 6 aa, Artificial Sequence
  Description of Artificial Sequence: Synthetic peptide
TDYLSI

SEQ ID NO: 934 - protein, 6 aa, Artificial Sequence
  Description of Artificial Sequence: Synthetic peptide
TDYQQV

SEQ ID NO: 935 - protein, 6 aa, Artificial Sequence
  Description of Artificial Sequence: Synthetic peptide
TDYYRV

SEQ ID NO: 936 - protein, 6 aa, Artificial Sequence
  Description of Artificial Sequence: Synthetic peptide
TEYASI

SEQ ID NO: 937 - protein, 6 aa, Artificial Sequence
  Description of Artificial Sequence: Synthetic peptide
TEYATI

SEQ ID NO: 938 - protein, 6 aa, Artificial Sequence
  Description of Artificial Sequence: Synthetic peptide
TEYDTI

SEQ ID NO: 939 - protein, 6 aa, Artificial Sequence
  Description of Artificial Sequence: Synthetic peptide
TEYPLV

SEQ ID NO: 940 - protein, 6 aa, Artificial Sequence
  Description of Artificial Sequence: Synthetic peptide
TEYSEI

SEQ ID NO: 941 - protein, 6 aa, Artificial Sequence
  Description of Artificial Sequence: Synthetic peptide
TEYSEV

SEQ ID NO: 942 - protein, 6 aa, Artificial Sequence
  Description of Artificial Sequence: Synthetic peptide
TEYSTI

SEQ ID NO: 943 - protein, 6 aa, Artificial Sequence
  Description of Artificial Sequence: Synthetic peptide
TEYTKV

SEQ ID NO: 944 - protein, 6 aa, Artificial Sequence
  Description of Artificial Sequence: Synthetic peptide
TFYHVV

SEQ ID NO: 945 - protein, 6 aa, Artificial Sequence
  Description of Artificial Sequence: Synthetic peptide
TFYLLI

SEQ ID NO: 946 - protein, 6 aa, Artificial Sequence
  Description of Artificial Sequence: Synthetic peptide
TFYNKI

SEQ ID NO: 947 - protein, 6 aa, Artificial Sequence
  Description of Artificial Sequence: Synthetic peptide
TFYPDI

SEQ ID NO: 948 - protein, 6 aa, Artificial Sequence
  Description of Artificial Sequence: Synthetic peptide
TGYEDV

SEQ ID NO: 949 - protein, 6 aa, Artificial Sequence
  Description of Artificial Sequence: Synthetic peptide
TGYLSI

SEQ ID NO: 950 - protein, 6 aa, Artificial Sequence
  Description of Artificial Sequence: Synthetic peptide
THYKEI

SEQ ID NO: 951 - protein, 6 aa, Artificial Sequence
  Description of Artificial Sequence: Synthetic peptide
TIYAQV

SEQ ID NO: 952 - protein, 6 aa, Artificial Sequence
  Description of Artificial Sequence: Synthetic peptide
TIYAVV

SEQ ID NO: 953 - protein, 6 aa, Artificial Sequence
  Description of Artificial Sequence: Synthetic peptide
TIYCSI

SEQ ID NO: 954 - protein, 6 aa, Artificial Sequence
  Description of Artificial Sequence: Synthetic peptide
TIYEDV

SEQ ID NO: 955 - protein, 6 aa, Artificial Sequence
  Description of Artificial Sequence: Synthetic peptide
TIYERI

SEQ ID NO: 956 - protein, 6 aa, Artificial Sequence
  Description of Artificial Sequence: Synthetic peptide
TIYEVI

SEQ ID NO: 957 - protein, 6 aa, Artificial Sequence
  Description of Artificial Sequence: Synthetic peptide
TIYHVI

SEQ ID NO: 958 - protein, 6 aa, Artificial Sequence
  Description of Artificial Sequence: Synthetic peptide
TIYIGV

SEQ ID NO: 959 - protein, 6 aa, Artificial Sequence
  Description of Artificial Sequence: Synthetic peptide
TIYLKV

SEQ ID NO: 960 - protein, 6 aa, Artificial Sequence
  Description of Artificial Sequence: Synthetic peptide
TIYSMI

SEQ ID NO: 961 - protein, 6 aa, Artificial Sequence
  Description of Artificial Sequence: Synthetic peptide
TIYSTI

SEQ ID NO: 962 - protein, 6 aa, Artificial Sequence
  Description of Artificial Sequence: Synthetic peptide
TIYTYI

SEQ ID NO: 963 - protein, 6 aa, Artificial Sequence
  Description of Artificial Sequence: Synthetic peptide
TKYFHI

SEQ ID NO: 964 - protein, 6 aa, Artificial Sequence
  Description of Artificial Sequence: Synthetic peptide
TKYMEI

SEQ ID NO: 965 - protein, 6 aa, Artificial Sequence
  Description of Artificial Sequence: Synthetic peptide
TKYQSV

SEQ ID NO: 966 - protein, 6 aa, Artificial Sequence
  Description of Artificial Sequence: Synthetic peptide
TKYSNI

SEQ ID NO: 967 - protein, 6 aa, Artificial Sequence
  Description of Artificial Sequence: Synthetic peptide
TKYSTV

SEQ ID NO: 968 - protein, 6 aa, Artificial Sequence
  Description of Artificial Sequence: Synthetic peptide
TLYASV

SEQ ID NO: 969 - protein, 6 aa, Artificial Sequence
  Description of Artificial Sequence: Synthetic peptide
TLYAVV

SEQ ID NO: 970 - protein, 6 aa, Artificial Sequence
  Description of Artificial Sequence: Synthetic peptide
TLYFWV

SEQ ID NO: 971 - protein, 6 aa, Artificial Sequence
  Description of Artificial Sequence: Synthetic peptide
TLYHLV

SEQ ID NO: 972 - protein, 6 aa, Artificial Sequence
  Description of Artificial Sequence: Synthetic peptide
TLYPMV

SEQ ID NO: 973 - protein, 6 aa, Artificial Sequence
  Description of Artificial Sequence: Synthetic peptide
TLYPPI

SEQ ID NO: 974 - protein, 6 aa, Artificial Sequence
  Description of Artificial Sequence: Synthetic peptide
TLYRDI

SEQ ID NO: 975 - protein, 6 aa, Artificial Sequence
  Description of Artificial Sequence: Synthetic peptide
TLYRDV

SEQ ID NO: 976 - protein, 6 aa, Artificial Sequence
  Description of Artificial Sequence: Synthetic peptide
TLYSKI

SEQ ID NO: 977 - protein, 6 aa, Artificial Sequence
  Description of Artificial Sequence: Synthetic peptide
TLYSLI

SEQ ID NO: 978 - protein, 6 aa, Artificial Sequence
  Description of Artificial Sequence: Synthetic peptide
TLYSPV

SEQ ID NO: 979 - protein, 6 aa, Artificial Sequence
  Description of Artificial Sequence: Synthetic peptide
TMYAQV

SEQ ID NO: 980 - protein, 6 aa, Artificial Sequence
  Description of Artificial Sequence: Synthetic peptide
TMYCQV

SEQ ID NO: 981 - protein, 6 aa, Artificial Sequence
  Description of Artificial Sequence: Synthetic peptide
TNYKAV

SEQ ID NO: 982 - protein, 6 aa, Artificial Sequence
  Description of Artificial Sequence: Synthetic peptide
TNYNLV

SEQ ID NO: 983 - protein, 6 aa, Artificial Sequence
  Description of Artificial Sequence: Synthetic peptide
TPYAGI

SEQ ID NO: 984 - protein, 6 aa, Artificial Sequence
  Description of Artificial Sequence: Synthetic peptide
TPYPGV

SEQ ID NO: 985 - protein, 6 aa, Artificial Sequence
  Description of Artificial Sequence: Synthetic peptide
TPYVDI

SEQ ID NO: 986 - protein, 6 aa, Artificial Sequence
  Description of Artificial Sequence: Synthetic peptide
TQYGRV

SEQ ID NO: 987 - protein, 6 aa, Artificial Sequence
  Description of Artificial Sequence: Synthetic peptide
TQYNQV

SEQ ID NO: 988 - protein, 6 aa, Artificial Sequence
  Description of Artificial Sequence: Synthetic peptide
TRYAYV

SEQ ID NO: 989 - protein, 6 aa, Artificial Sequence
  Description of Artificial Sequence: Synthetic peptide
TRYGEV

SEQ ID NO: 990 - protein, 6 aa, Artificial Sequence
  Description of Artificial Sequence: Synthetic peptide
TRYHSV

SEQ ID NO: 991 - protein, 6 aa, Artificial Sequence
  Description of Artificial Sequence: Synthetic peptide
TRYKTI

SEQ ID NO: 992 - protein, 6 aa, Artificial Sequence
  Description of Artificial Sequence: Synthetic peptide
TRYLAI

SEQ ID NO: 993 - protein, 6 aa, Artificial Sequence
  Description of Artificial Sequence: Synthetic peptide
TRYMAI

SEQ ID NO: 994 - protein, 6 aa, Artificial Sequence
  Description of Artificial Sequence: Synthetic peptide
TRYQKI

SEQ ID NO: 995 - protein, 6 aa, Artificial Sequence
  Description of Artificial Sequence: Synthetic peptide
TRYQQI

SEQ ID NO: 996 - protein, 6 aa, Artificial Sequence
  Description of Artificial Sequence: Synthetic peptide
TRYSNI

SEQ ID NO: 997 - protein, 6 aa, Artificial Sequence
  Description of Artificial Sequence: Synthetic peptide
TRYSPI

SEQ ID NO: 998 - protein, 6 aa, Artificial Sequence
  Description of Artificial Sequence: Synthetic peptide
TSYGTV

SEQ ID NO: 999 - protein, 6 aa, Artificial Sequence
  Description of Artificial Sequence: Synthetic peptide
TSYMEV

SEQ ID NO: 1000 - protein, 6 aa, Artificial Sequence
  Description of Artificial Sequence: Synthetic peptide
TSYQGV

SEQ ID NO: 1001 - protein, 6 aa, Artificial Sequence
  Description of Artificial Sequence: Synthetic peptide
TSYTTI

SEQ ID NO: 1002 - protein, 6 aa, Artificial Sequence
  Description of Artificial Sequence: Synthetic peptide
TTYRSI

SEQ ID NO: 1003 - protein, 6 aa, Artificial Sequence
  Description of Artificial Sequence: Synthetic peptide
TTYSDV

SEQ ID NO: 1004 - protein, 6 aa, Artificial Sequence
  Description of Artificial Sequence: Synthetic peptide
TTYVTI

SEQ ID NO: 1005 - protein, 6 aa, Artificial Sequence
  Description of Artificial Sequence: Synthetic peptide
TVYAQI

SEQ ID NO: 1006 - protein, 6 aa, Artificial Sequence
  Description of Artificial Sequence: Synthetic peptide
TVYASV

SEQ ID NO: 1007 - protein, 6 aa, Artificial Sequence
  Description of Artificial Sequence: Synthetic peptide
TVYEVI

SEQ ID NO: 1008 - protein, 6 aa, Artificial Sequence
  Description of Artificial Sequence: Synthetic peptide
TVYGDV

SEQ ID NO: 1009 - protein, 6 aa, Artificial Sequence
  Description of Artificial Sequence: Synthetic peptide
TVYKGI

SEQ ID NO: 1010 - protein, 6 aa, Artificial Sequence
  Description of Artificial Sequence: Synthetic peptide
TVYQRV

SEQ ID NO: 1011 - protein, 6 aa, Artificial Sequence
  Description of Artificial Sequence: Synthetic peptide
TVYSEV

SEQ ID NO: 1012 - protein, 6 aa, Artificial Sequence
  Description of Artificial Sequence: Synthetic peptide
TVYSTV

SEQ ID NO: 1013 - protein, 6 aa, Artificial Sequence
  Description of Artificial Sequence: Synthetic peptide
TYYHSI

SEQ ID NO: 1014 - protein, 6 aa, Artificial Sequence
  Description of Artificial Sequence: Synthetic peptide
TYYLQI

SEQ ID NO: 1015 - protein, 6 aa, Artificial Sequence
  Description of Artificial Sequence: Synthetic peptide
TYYYSV

SEQ ID NO: 1016 - protein, 6 aa, Artificial Sequence
  Description of Artificial Sequence: Synthetic peptide
LLYEMV

SEQ ID NO: 1017 - protein, 6 aa, Artificial Sequence
  Description of Artificial Sequence: Synthetic peptide
ITYFAL

SEQ ID NO: 1018 - protein, 6 aa, Artificial Sequence
  Description of Artificial Sequence: Synthetic peptide
ISYKGL

SEQ ID NO: 1019 - protein, 6 aa, Artificial Sequence
  Description of Artificial Sequence: Synthetic peptide
LAYHTV

SEQ ID NO: 1020 - protein, 6 aa, Artificial Sequence
  Description of Artificial Sequence: Synthetic peptide
VQYLRL

SEQ ID NO: 1021 - protein, 6 aa, Artificial Sequence
  Description of Artificial Sequence: Synthetic peptide
LTYVLL

SEQ ID NO: 1022 - protein, 6 aa, Artificial Sequence
  Description of Artificial Sequence: Synthetic peptide
VRYSIV

SEQ ID NO: 1023 - protein, 6 aa, Artificial Sequence
  Description of Artificial Sequence: Synthetic peptide
LLYLLL

SEQ ID NO: 1024 - protein, 6 aa, Artificial Sequence
  Description of Artificial Sequence: Synthetic peptide
IAYGDI

SEQ ID NO: 1025 - protein, 6 aa, Artificial Sequence
  Description of Artificial Sequence: Synthetic peptide
IAYRDL

SEQ ID NO: 1026 - protein, 6 aa, Artificial Sequence
  Description of Artificial Sequence: Synthetic peptide
IAYSLL

SEQ ID NO: 1027 - protein, 6 aa, Artificial Sequence
  Description of Artificial Sequence: Synthetic peptide
IAYSRL

SEQ ID NO: 1028 - protein, 6 aa, Artificial Sequence
  Description of Artificial Sequence: Synthetic peptide
ICYALL

SEQ ID NO: 1029 - protein, 6 aa, Artificial Sequence
  Description of Artificial Sequence: Synthetic peptide
ICYDAL

SEQ ID NO: 1030 - protein, 6 aa, Artificial Sequence
  Description of Artificial Sequence: Synthetic peptide
ICYPLL

SEQ ID NO: 1031 - protein, 6 aa, Artificial Sequence
  Description of Artificial Sequence: Synthetic peptide
ICYQLI

SEQ ID NO: 1032 - protein, 6 aa, Artificial Sequence
  Description of Artificial Sequence: Synthetic peptide
IDYILV

SEQ ID NO: 1033 - protein, 6 aa, Artificial Sequence
  Description of Artificial Sequence: Synthetic peptide
IDYKTL

SEQ ID NO: 1034 - protein, 6 aa, Artificial Sequence
  Description of Artificial Sequence: Synthetic peptide
IDYTQL

SEQ ID NO: 1035 - protein, 6 aa, Artificial Sequence
  Description of Artificial Sequence: Synthetic peptide
IDYYNL

SEQ ID NO: 1036 - protein, 6 aa, Artificial Sequence
  Description of Artificial Sequence: Synthetic peptide
IEYCKL

SEQ ID NO: 1037 - protein, 6 aa, Artificial Sequence
  Description of Artificial Sequence: Synthetic peptide
IEYDQI

SEQ ID NO: 1038 - protein, 6 aa, Artificial Sequence
  Description of Artificial Sequence: Synthetic peptide
IEYGPL

SEQ ID NO: 1039 - protein, 6 aa, Artificial Sequence
  Description of Artificial Sequence: Synthetic peptide
IEYIRV

SEQ ID NO: 1040 - protein, 6 aa, Artificial Sequence
  Description of Artificial Sequence: Synthetic peptide
IEYKSL

SEQ ID NO: 1041 - protein, 6 aa, Artificial Sequence
  Description of Artificial Sequence: Synthetic peptide
IEYKTL

SEQ ID NO: 1042 - protein, 6 aa, Artificial Sequence
  Description of Artificial Sequence: Synthetic peptide
IEYSVL

SEQ ID NO: 1043 - protein, 6 aa, Artificial Sequence
  Description of Artificial Sequence: Synthetic peptide
IEYWGI

SEQ ID NO: 1044 - protein, 6 aa, Artificial Sequence
  Description of Artificial Sequence: Synthetic peptide
IFYGNV

SEQ ID NO: 1045 - protein, 6 aa, Artificial Sequence
  Description of Artificial Sequence: Synthetic peptide
IFYHNL

SEQ ID NO: 1046 - protein, 6 aa, Artificial Sequence
  Description of Artificial Sequence: Synthetic peptide
IFYKDI

SEQ ID NO: 1047 - protein, 6 aa, Artificial Sequence
  Description of Artificial Sequence: Synthetic peptide
IFYQNV

SEQ ID NO: 1048 - protein, 6 aa, Artificial Sequence
  Description of Artificial Sequence: Synthetic peptide
IFYRLI

SEQ ID NO: 1049 - protein, 6 aa, Artificial Sequence
  Description of Artificial Sequence: Synthetic peptide
IGYDIL

SEQ ID NO: 1050 - protein, 6 aa, Artificial Sequence
  Description of Artificial Sequence: Synthetic peptide
IGYDVL

SEQ ID NO: 1051 - protein, 6 aa, Artificial Sequence
  Description of Artificial Sequence: Synthetic peptide
IGYICL

SEQ ID NO: 1052 - protein, 6 aa, Artificial Sequence
  Description of Artificial Sequence: Synthetic peptide
IGYKAI

SEQ ID NO: 1053 - protein, 6 aa, Artificial Sequence
  Description of Artificial Sequence: Synthetic peptide
IGYLEL

SEQ ID NO: 1054 - protein, 6 aa, Artificial Sequence
  Description of Artificial Sequence: Synthetic peptide
IGYLPL

SEQ ID NO: 1055 - protein, 6 aa, Artificial Sequence
  Description of Artificial Sequence: Synthetic peptide
IGYLRL

SEQ ID NO: 1056 - protein, 6 aa, Artificial Sequence
  Description of Artificial Sequence: Synthetic peptide
IGYPFL

SEQ ID NO: 1057 - protein, 6 aa, Artificial Sequence
  Description of Artificial Sequence: Synthetic peptide
IGYSDL

SEQ ID NO: 1058 - protein, 6 aa, Artificial Sequence
  Description of Artificial Sequence: Synthetic peptide
IHYRQI

SEQ ID NO: 1059 - protein, 6 aa, Artificial Sequence
  Description of Artificial Sequence: Synthetic peptide
IHYSEL

SEQ ID NO: 1060 - protein, 6 aa, Artificial Sequence
  Description of Artificial Sequence: Synthetic peptide
IIYAFL

SEQ ID NO: 1061 - protein, 6 aa, Artificial Sequence
  Description of Artificial Sequence: Synthetic peptide
IIYHVI

SEQ ID NO: 1062 - protein, 6 aa, Artificial Sequence
  Description of Artificial Sequence: Synthetic peptide
IIYMFL

SEQ ID NO: 1063 - protein, 6 aa, Artificial Sequence
  Description of Artificial Sequence: Synthetic peptide
IIYNLL

SEQ ID NO: 1064 - protein, 6 aa, Artificial Sequence
  Description of Artificial Sequence: Synthetic peptide
IIYNNL

SEQ ID NO: 1065 - protein, 6 aa, Artificial Sequence
  Description of Artificial Sequence: Synthetic peptide
IIYSEV

SEQ ID NO: 1066 - protein, 6 aa, Artificial Sequence
  Description of Artificial Sequence: Synthetic peptide
IKYCLV

SEQ ID NO: 1067 - protein, 6 aa, Artificial Sequence
  Description of Artificial Sequence: Synthetic peptide
IKYKEL

SEQ ID NO: 1068 - protein, 6 aa, Artificial Sequence
  Description of Artificial Sequence: Synthetic peptide
IKYLAL

SEQ ID NO: 1069 - protein, 6 aa, Artificial Sequence
  Description of Artificial Sequence: Synthetic peptide
IKYTCI

SEQ ID NO: 1070 - protein, 6 aa, Artificial Sequence
  Description of Artificial Sequence: Synthetic peptide
ILYADI

SEQ ID NO: 1071 - protein, 6 aa, Artificial Sequence
  Description of Artificial Sequence: Synthetic peptide
ILYAFL

SEQ ID NO: 1072 - protein, 6 aa, Artificial Sequence
  Description of Artificial Sequence: Synthetic peptide
ILYCSV

SEQ ID NO: 1073 - protein, 6 aa, Artificial Sequence
  Description of Artificial Sequence: Synthetic peptide
ILYEGL

SEQ ID NO: 1074 - protein, 6 aa, Artificial Sequence
  Description of Artificial Sequence: Synthetic peptide
ILYELL

SEQ ID NO: 1075 - protein, 6 aa, Artificial Sequence
  Description of Artificial Sequence: Synthetic peptide
ILYFQI

SEQ ID NO: 1076 - protein, 6 aa, Artificial Sequence
  Description of Artificial Sequence: Synthetic peptide
ILYHTV

SEQ ID NO: 1077 - protein, 6 aa, Artificial Sequence
  Description of Artificial Sequence: Synthetic peptide
ILYLQV

SEQ ID NO: 1078 - protein, 6 aa, Artificial Sequence
  Description of Artificial Sequence: Synthetic peptide
ILYSIL

SEQ ID NO: 1079 - protein, 6 aa, Artificial Sequence
  Description of Artificial Sequence: Synthetic peptide
ILYSVL

SEQ ID NO: 1080 - protein, 6 aa, Artificial Sequence
  Description of Artificial Sequence: Synthetic peptide
ILYTEL

SEQ ID NO: 1081 - protein, 6 aa, Artificial Sequence
  Description of Artificial Sequence: Synthetic peptide
ILYTIL

SEQ ID NO: 1082 - protein, 6 aa, Artificial Sequence
  Description of Artificial Sequence: Synthetic peptide
IMYTLV

SEQ ID NO: 1083 - protein, 6 aa, Artificial Sequence
  Description of Artificial Sequence: Synthetic peptide
INYCSV

SEQ ID NO: 1084 - protein, 6 aa, Artificial Sequence
  Description of Artificial Sequence: Synthetic peptide
INYKDI

SEQ ID NO: 1085 - protein, 6 aa, Artificial Sequence
  Description of Artificial Sequence: Synthetic peptide
INYTTV

SEQ ID NO: 1086 - protein, 6 aa, Artificial Sequence
  Description of Artificial Sequence: Synthetic peptide
INYVLL

SEQ ID NO: 1087 - protein, 6 aa, Artificial Sequence
  Description of Artificial Sequence: Synthetic peptide
IPYDVL

SEQ ID NO: 1088 - protein, 6 aa, Artificial Sequence
  Description of Artificial Sequence: Synthetic peptide
IPYLLV

SEQ ID NO: 1089 - protein, 6 aa, Artificial Sequence
  Description of Artificial Sequence: Synthetic peptide
IPYRTV

SEQ ID NO: 1090 - protein, 6 aa, Artificial Sequence
  Description of Artificial Sequence: Synthetic peptide
IPYSQL

SEQ ID NO: 1091 - protein, 6 aa, Artificial Sequence
  Description of Artificial Sequence: Synthetic peptide
IPYSRI

SEQ ID NO: 1092 - protein, 6 aa, Artificial Sequence
  Description of Artificial Sequence: Synthetic peptide
IPYTQI

SEQ ID NO: 1093 - protein, 6 aa, Artificial Sequence
  Description of Artificial Sequence: Synthetic peptide
IQYAPL

SEQ ID NO: 1094 - protein, 6 aa, Artificial Sequence
  Description of Artificial Sequence: Synthetic peptide
IQYASL

SEQ ID NO: 1095 - protein, 6 aa, Artificial Sequence
  Description of Artificial Sequence: Synthetic peptide
IQYERL

SEQ ID NO: 1096 - protein, 6 aa, Artificial Sequence
  Description of Artificial Sequence: Synthetic peptide
IQYGII

SEQ ID NO: 1097 - protein, 6 aa, Artificial Sequence
  Description of Artificial Sequence: Synthetic peptide
IQYGNV

SEQ ID NO: 1098 - protein, 6 aa, Artificial Sequence
  Description of Artificial Sequence: Synthetic peptide
IQYGRV

SEQ ID NO: 1099 - protein, 6 aa, Artificial Sequence
  Description of Artificial Sequence: Synthetic peptide
IQYNVV

SEQ ID NO: 1100 - protein, 6 aa, Artificial Sequence
  Description of Artificial Sequence: Synthetic peptide
IQYRSI

SEQ ID NO: 1101 - protein, 6 aa, Artificial Sequence
  Description of Artificial Sequence: Synthetic peptide
TVYSEV

SEQ ID NO: 1102 - protein, 6 aa, Artificial Sequence
  Description of Artificial Sequence: Synthetic peptide
IQYWGI

SEQ ID NO: 1103 - protein, 6 aa, Artificial Sequence
  Description of Artificial Sequence: Synthetic peptide
IRYANL

SEQ ID NO: 1104 - protein, 6 aa, Artificial Sequence
  Description of Artificial Sequence: Synthetic peptide
IRYLDL

SEQ ID NO: 1105 - protein, 6 aa, Artificial Sequence
  Description of Artificial Sequence: Synthetic peptide
IRYPLL

SEQ ID NO: 1106 - protein, 6 aa, Artificial Sequence
  Description of Artificial Sequence: Synthetic peptide
IRYRLL

SEQ ID NO: 1107 - protein, 6 aa, Artificial Sequence
  Description of Artificial Sequence: Synthetic peptide
IRYRTI

SEQ ID NO: 1108 - protein, 6 aa, Artificial Sequence
  Description of Artificial Sequence: Synthetic peptide
ISYASL

SEQ ID NO: 1109 - protein, 6 aa, Artificial Sequence
  Description of Artificial Sequence: Synthetic peptide
ISYCGV

SEQ ID NO: 1110 - protein, 6 aa, Artificial Sequence
  Description of Artificial Sequence: Synthetic peptide
ISYEPI

SEQ ID NO: 1111 - protein, 6 aa, Artificial Sequence
  Description of Artificial Sequence: Synthetic peptide
ISYFQI

SEQ ID NO: 1112 - protein, 6 aa, Artificial Sequence
  Description of Artificial Sequence: Synthetic peptide
ISYGLI

SEQ ID NO: 1113 - protein, 6 aa, Artificial Sequence
  Description of Artificial Sequence: Synthetic peptide
ISYKKL

SEQ ID NO: 1114 - protein, 6 aa, Artificial Sequence
  Description of Artificial Sequence: Synthetic peptide
ISYLPL

SEQ ID NO: 1115 - protein, 6 aa, Artificial Sequence
  Description of Artificial Sequence: Synthetic peptide
ISYPML

SEQ ID NO: 1116 - protein, 6 aa, Artificial Sequence
  Description of Artificial Sequence: Synthetic peptide
ISYTTL

SEQ ID NO: 1117 - protein, 6 aa, Artificial Sequence
  Description of Artificial Sequence: Synthetic peptide
ITYAAV

SEQ ID NO: 1118 - protein, 6 aa, Artificial Sequence
  Description of Artificial Sequence: Synthetic peptide
ITYADL

SEQ ID NO: 1119 - protein, 6 aa, Artificial Sequence
  Description of Artificial Sequence: Synthetic peptide
ITYAEL

SEQ ID NO: 1120 - protein, 6 aa, Artificial Sequence
  Description of Artificial Sequence: Synthetic peptide
ITYAEV

SEQ ID NO: 1121 - protein, 6 aa, Artificial Sequence
  Description of Artificial Sequence: Synthetic peptide
ITYASV

SEQ ID NO: 1122 - protein, 6 aa, Artificial Sequence
  Description of Artificial Sequence: Synthetic peptide
ITYDLI

SEQ ID NO: 1123 - protein, 6 aa, Artificial Sequence
  Description of Artificial Sequence: Synthetic peptide
ITYENV

SEQ ID NO: 1124 - protein, 6 aa, Artificial Sequence
  Description of Artificial Sequence: Synthetic peptide
ITYQLL

SEQ ID NO: 1125 - protein, 6 aa, Artificial Sequence
  Description of Artificial Sequence: Synthetic peptide
ITYSLL

SEQ ID NO: 1126 - protein, 6 aa, Artificial Sequence
  Description of Artificial Sequence: Synthetic peptide
IVYAEL

SEQ ID NO: 1127 - protein, 6 aa, Artificial Sequence
  Description of Artificial Sequence: Synthetic peptide
IVYALV

SEQ ID NO: 1128 - protein, 6 aa, Artificial Sequence
  Description of Artificial Sequence: Synthetic peptide
IVYASL

SEQ ID NO: 1129 - protein, 6 aa, Artificial Sequence
  Description of Artificial Sequence: Synthetic peptide
IVYEIL

SEQ ID NO: 1130 - protein, 6 aa, Artificial Sequence
  Description of Artificial Sequence: Synthetic peptide
IVYFIL

SEQ ID NO: 1131 - protein, 6 aa, Artificial Sequence
  Description of Artificial Sequence: Synthetic peptide
IVYHML

SEQ ID NO: 1132 - protein, 6 aa, Artificial Sequence
  Description of Artificial Sequence: Synthetic peptide
IVYLCI

SEQ ID NO: 1133 - protein, 6 aa, Artificial Sequence
  Description of Artificial Sequence: Synthetic peptide
IVYRLL

SEQ ID NO: 1134 - protein, 6 aa, Artificial Sequence
  Description of Artificial Sequence: Synthetic peptide
IVYSAL

SEQ ID NO: 1135 - protein, 6 aa, Artificial Sequence
  Description of Artificial Sequence: Synthetic peptide
IVYSWV

SEQ ID NO: 1136 - protein, 6 aa, Artificial Sequence
  Description of Artificial Sequence: Synthetic peptide
IVYTEL

SEQ ID NO: 1137 - protein, 6 aa, Artificial Sequence
  Description of Artificial Sequence: Synthetic peptide
IVYYIL

SEQ ID NO: 1138 - protein, 6 aa, Artificial Sequence
  Description of Artificial Sequence: Synthetic peptide
IWYENL

SEQ ID NO: 1139 - protein, 6 aa, Artificial Sequence
  Description of Artificial Sequence: Synthetic peptide
IWYFVV

SEQ ID NO: 1140 - protein, 6 aa, Artificial Sequence
  Description of Artificial Sequence: Synthetic peptide
IWYNIL

SEQ ID NO: 1141 - protein, 6 aa, Artificial Sequence
  Description of Artificial Sequence: Synthetic peptide
IYYLGV

SEQ ID NO: 1142 - protein, 6 aa, Artificial Sequence
  Description of Artificial Sequence: Synthetic peptide
LAYALL

SEQ ID NO: 1143 - protein, 6 aa, Artificial Sequence
  Description of Artificial Sequence: Synthetic peptide
LAYARI

SEQ ID NO: 1144 - protein, 6 aa, Artificial Sequence
  Description of Artificial Sequence: Synthetic peptide
LAYDSV

SEQ ID NO: 1145 - protein, 6 aa, Artificial Sequence
  Description of Artificial Sequence: Synthetic peptide
LAYFGV

SEQ ID NO: 1146 - protein, 6 aa, Artificial Sequence
  Description of Artificial Sequence: Synthetic peptide
LAYHRL

SEQ ID NO: 1147 - protein, 6 aa, Artificial Sequence
  Description of Artificial Sequence: Synthetic peptide
LAYKDL

SEQ ID NO: 1148 - protein, 6 aa, Artificial Sequence
  Description of Artificial Sequence: Synthetic peptide
LAYKRI

SEQ ID NO: 1149 - protein, 6 aa, Artificial Sequence
  Description of Artificial Sequence: Synthetic peptide
LAYPPL

SEQ ID NO: 1150 - protein, 6 aa, Artificial Sequence
  Description of Artificial Sequence: Synthetic peptide
LAYQTL

SEQ ID NO: 1151 - protein, 6 aa, Artificial Sequence
  Description of Artificial Sequence: Synthetic peptide
LAYREV

SEQ ID NO: 1152 - protein, 6 aa, Artificial Sequence
  Description of Artificial Sequence: Synthetic peptide
LAYRII

SEQ ID NO: 1153 - protein, 6 aa, Artificial Sequence
  Description of Artificial Sequence: Synthetic peptide
LAYRLL

SEQ ID NO: 1154 - protein, 6 aa, Artificial Sequence
  Description of Artificial Sequence: Synthetic peptide
LAYSQL

SEQ ID NO: 1155 - protein, 6 aa, Artificial Sequence
  Description of Artificial Sequence: Synthetic peptide
LAYSSV

SEQ ID NO: 1156 - protein, 6 aa, Artificial Sequence
  Description of Artificial Sequence: Synthetic peptide
LAYTLL

SEQ ID NO: 1157 - protein, 6 aa, Artificial Sequence
  Description of Artificial Sequence: Synthetic peptide
LAYWGI

SEQ ID NO: 1158 - protein, 6 aa, Artificial Sequence
  Description of Artificial Sequence: Synthetic peptide
LAYYTV

SEQ ID NO: 1159 - protein, 6 aa, Artificial Sequence
  Description of Artificial Sequence: Synthetic peptide
LCYADL

SEQ ID NO: 1160 - protein, 6 aa, Artificial Sequence
  Description of Artificial Sequence: Synthetic peptide
LCYAIL

SEQ ID NO: 1161 - protein, 6 aa, Artificial Sequence
  Description of Artificial Sequence: Synthetic peptide
LCYFHL

SEQ ID NO: 1162 - protein, 6 aa, Artificial Sequence
  Description of Artificial Sequence: Synthetic peptide
LCYHPI

SEQ ID NO: 1163 - protein, 6 aa, Artificial Sequence
  Description of Artificial Sequence: Synthetic peptide
LCYKEI

SEQ ID NO: 1164 - protein, 6 aa, Artificial Sequence
  Description of Artificial Sequence: Synthetic peptide
LCYKFL

SEQ ID NO: 1165 - protein, 6 aa, Artificial Sequence
  Description of Artificial Sequence: Synthetic peptide
LCYMII

SEQ ID NO: 1166 - protein, 6 aa, Artificial Sequence
  Description of Artificial Sequence: Synthetic peptide
LCYRKI

SEQ ID NO: 1167 - protein, 6 aa, Artificial Sequence
  Description of Artificial Sequence: Synthetic peptide
LCYRVL

SEQ ID NO: 1168 - protein, 6 aa, Artificial Sequence
  Description of Artificial Sequence: Synthetic peptide
LCYSTV

SEQ ID NO: 1169 - protein, 6 aa, Artificial Sequence
  Description of Artificial Sequence: Synthetic peptide
LCYTLV

SEQ ID NO: 1170 - protein, 6 aa, Artificial Sequence
  Description of Artificial Sequence: Synthetic peptide
LDYASI

SEQ ID NO: 1171 - protein, 6 aa, Artificial Sequence
  Description of Artificial Sequence: Synthetic peptide
LDYCEL

SEQ ID NO: 1172 - protein, 6 aa, Artificial Sequence
  Description of Artificial Sequence: Synthetic peptide
LDYDKI

SEQ ID NO: 1173 - protein, 6 aa, Artificial Sequence
  Description of Artificial Sequence: Synthetic peptide
LDYDKL

SEQ ID NO: 1174 - protein, 6 aa, Artificial Sequence
  Description of Artificial Sequence: Synthetic peptide
LDYDYL

SEQ ID NO: 1175 - protein, 6 aa, Artificial Sequence
  Description of Artificial Sequence: Synthetic peptide
LDYDYV

SEQ ID NO: 1176 - protein, 6 aa, Artificial Sequence
  Description of Artificial Sequence: Synthetic peptide
LDYEFL

SEQ ID NO: 1177 - protein, 6 aa, Artificial Sequence
  Description of Artificial Sequence: Synthetic peptide
LDYINV

SEQ ID NO: 1178 - protein, 6 aa, Artificial Sequence
  Description of Artificial Sequence: Synthetic peptide
LDYNNL

SEQ ID NO: 1179 - protein, 6 aa, Artificial Sequence
  Description of Artificial Sequence: Synthetic peptide
LDYPHV

SEQ ID NO: 1180 - protein, 6 aa, Artificial Sequence
  Description of Artificial Sequence: Synthetic peptide
LDYSPV

SEQ ID NO: 1181 - protein, 6 aa, Artificial Sequence
  Description of Artificial Sequence: Synthetic peptide
LDYVEI

SEQ ID NO: 1182 - protein, 6 aa, Artificial Sequence
  Description of Artificial Sequence: Synthetic peptide
LDYWGI

SEQ ID NO: 1183 - protein, 6 aa, Artificial Sequence
  Description of Artificial Sequence: Synthetic peptide
LEYAPV

SEQ ID NO: 1184 - protein, 6 aa, Artificial Sequence
  Description of Artificial Sequence: Synthetic peptide
LEYIPL

SEQ ID NO: 1185 - protein, 6 aa, Artificial Sequence
  Description of Artificial Sequence: Synthetic peptide
LEYKTI

SEQ ID NO: 1186 - protein, 6 aa, Artificial Sequence
  Description of Artificial Sequence: Synthetic peptide
LEYLCL

SEQ ID NO: 1187 - protein, 6 aa, Artificial Sequence
  Description of Artificial Sequence: Synthetic peptide
LEYLKL

SEQ ID NO: 1188 - protein, 6 aa, Artificial Sequence
  Description of Artificial Sequence: Synthetic peptide
LEYLQI

SEQ ID NO: 1189 - protein, 6 aa, Artificial Sequence
  Description of Artificial Sequence: Synthetic peptide
LEYLQL

SEQ ID NO: 1190 - protein, 6 aa, Artificial Sequence
  Description of Artificial Sequence: Synthetic peptide
LEYQRL

SEQ ID NO: 1191 - protein, 6 aa, Artificial Sequence
  Description of Artificial Sequence: Synthetic peptide
LEYVDL

SEQ ID NO: 1192 - protein, 6 aa, Artificial Sequence
  Description of Artificial Sequence: Synthetic peptide
LEYVSV

SEQ ID NO: 1193 - protein, 6 aa, Artificial Sequence
  Description of Artificial Sequence: Synthetic peptide
LEYYQI

SEQ ID NO: 1194 - protein, 6 aa, Artificial Sequence
  Description of Artificial Sequence: Synthetic peptide
LFYAQL

SEQ ID NO: 1195 - protein, 6 aa, Artificial Sequence
  Description of Artificial Sequence: Synthetic peptide
LFYCSV

SEQ ID NO: 1196 - protein, 6 aa, Artificial Sequence
  Description of Artificial Sequence: Synthetic peptide
LFYERV

SEQ ID NO: 1197 - protein, 6 aa, Artificial Sequence
  Description of Artificial Sequence: Synthetic peptide
LFYGFL

SEQ ID NO: 1198 - protein, 6 aa, Artificial Sequence
  Description of Artificial Sequence: Synthetic peptide
LFYKYV

SEQ ID NO: 1199 - protein, 6 aa, Artificial Sequence
  Description of Artificial Sequence: Synthetic peptide
LFYLLL

SEQ ID NO: 1200 - protein, 6 aa, Artificial Sequence
  Description of Artificial Sequence: Synthetic peptide
LFYNKV

SEQ ID NO: 1201 - protein, 6 aa, Artificial Sequence
  Description of Artificial Sequence: Synthetic peptide
LFYRHL

SEQ ID NO: 1202 - protein, 6 aa, Artificial Sequence
  Description of Artificial Sequence: Synthetic peptide
LFYTLL

SEQ ID NO: 1203 - protein, 6 aa, Artificial Sequence
  Description of Artificial Sequence: Synthetic peptide
LFYWDV

SEQ ID NO: 1204 - protein, 6 aa, Artificial Sequence
  Description of Artificial Sequence: Synthetic peptide
LFYWKL

SEQ ID NO: 1205 - protein, 6 aa, Artificial Sequence
  Description of Artificial Sequence: Synthetic peptide
LGYGNV

SEQ ID NO: 1206 - protein, 6 aa, Artificial Sequence
  Description of Artificial Sequence: Synthetic peptide
LGYKEL

SEQ ID NO: 1207 - protein, 6 aa, Artificial Sequence
  Description of Artificial Sequence: Synthetic peptide
LGYLQL

SEQ ID NO: 1208 - protein, 6 aa, Artificial Sequence
  Description of Artificial Sequence: Synthetic peptide
LGYPLI

SEQ ID NO: 1209 - protein, 6 aa, Artificial Sequence
  Description of Artificial Sequence: Synthetic peptide
LGYPWV

SEQ ID NO: 1210 - protein, 6 aa, Artificial Sequence
  Description of Artificial Sequence: Synthetic peptide
LGYSAL

SEQ ID NO: 1211 - protein, 6 aa, Artificial Sequence
  Description of Artificial Sequence: Synthetic peptide
LGYSDL

SEQ ID NO: 1212 - protein, 6 aa, Artificial Sequence
  Description of Artificial Sequence: Synthetic peptide
LGYVTL

SEQ ID NO: 1213 - protein, 6 aa, Artificial Sequence
  Description of Artificial Sequence: Synthetic peptide
LHYAKI

SEQ ID NO: 1214 - protein, 6 aa, Artificial Sequence
  Description of Artificial Sequence: Synthetic peptide
LHYALV

SEQ ID NO: 1215 - protein, 6 aa, Artificial Sequence
  Description of Artificial Sequence: Synthetic peptide
LHYANL

SEQ ID NO: 1216 - protein, 6 aa, Artificial Sequence
  Description of Artificial Sequence: Synthetic peptide
LHYARL

SEQ ID NO: 1217 - protein, 6 aa, Artificial Sequence
  Description of Artificial Sequence: Synthetic peptide
LHYASI

SEQ ID NO: 1218 - protein, 6 aa, Artificial Sequence
  Description of Artificial Sequence: Synthetic peptide
LHYASL

SEQ ID NO: 1219 - protein, 6 aa, Artificial Sequence
  Description of Artificial Sequence: Synthetic peptide
LHYASV

SEQ ID NO: 1220 - protein, 6 aa, Artificial Sequence
  Description of Artificial Sequence: Synthetic peptide
LHYATI

SEQ ID NO: 1221 - protein, 6 aa, Artificial Sequence
  Description of Artificial Sequence: Synthetic peptide
LHYATL

SEQ ID NO: 1222 - protein, 6 aa, Artificial Sequence
  Description of Artificial Sequence: Synthetic peptide
LHYAVL

SEQ ID NO: 1223 - protein, 6 aa, Artificial Sequence
  Description of Artificial Sequence: Synthetic peptide
LHYDVV

SEQ ID NO: 1224 - protein, 6 aa, Artificial Sequence
  Description of Artificial Sequence: Synthetic peptide
LHYEGL

SEQ ID NO: 1225 - protein, 6 aa, Artificial Sequence
  Description of Artificial Sequence: Synthetic peptide
LHYETI

SEQ ID NO: 1226 - protein, 6 aa, Artificial Sequence
  Description of Artificial Sequence: Synthetic peptide
LHYFEI

SEQ ID NO: 1227 - protein, 6 aa, Artificial Sequence
  Description of Artificial Sequence: Synthetic peptide
LHYFVV

SEQ ID NO: 1228 - protein, 6 aa, Artificial Sequence
  Description of Artificial Sequence: Synthetic peptide
LHYGAI

SEQ ID NO: 1229 - protein, 6 aa, Artificial Sequence
  Description of Artificial Sequence: Synthetic peptide
LHYILI

SEQ ID NO: 1230 - protein, 6 aa, Artificial Sequence
  Description of Artificial Sequence: Synthetic peptide
LHYINL

SEQ ID NO: 1231 - protein, 6 aa, Artificial Sequence
  Description of Artificial Sequence: Synthetic peptide
LHYKRI

SEQ ID NO: 1232 - protein, 6 aa, Artificial Sequence
  Description of Artificial Sequence: Synthetic peptide
LHYLDL

SEQ ID NO: 1233 - protein, 6 aa, Artificial Sequence
  Description of Artificial Sequence: Synthetic peptide
LHYLNI

SEQ ID NO: 1234 - protein, 6 aa, Artificial Sequence
  Description of Artificial Sequence: Synthetic peptide
LHYLTI

SEQ ID NO: 1235 - protein, 6 aa, Artificial Sequence
  Description of Artificial Sequence: Synthetic peptide
LHYLVI

SEQ ID NO: 1236 - protein, 6 aa, Artificial Sequence
  Description of Artificial Sequence: Synthetic peptide
LHYMAI

SEQ ID NO: 1237 - protein, 6 aa, Artificial Sequence
  Description of Artificial Sequence: Synthetic peptide
LHYMII

SEQ ID NO: 1238 - protein, 6 aa, Artificial Sequence
  Description of Artificial Sequence: Synthetic peptide
LHYMNI

SEQ ID NO: 1239 - protein, 6 aa, Artificial Sequence
  Description of Artificial Sequence: Synthetic peptide
LHYMTI

SEQ ID NO: 1240 - protein, 6 aa, Artificial Sequence
  Description of Artificial Sequence: Synthetic peptide
LHYMTL

SEQ ID NO: 1241 - protein, 6 aa, Artificial Sequence
  Description of Artificial Sequence: Synthetic peptide
LHYMTV

SEQ ID NO: 1242 - protein, 6 aa, Artificial Sequence
  Description of Artificial Sequence: Synthetic peptide
LHYMVI

SEQ ID NO: 1243 - protein, 6 aa, Artificial Sequence
  Description of Artificial Sequence: Synthetic peptide
LHYNML

SEQ ID NO: 1244 - protein, 6 aa, Artificial Sequence
  Description of Artificial Sequence: Synthetic peptide
LHYPAL

SEQ ID NO: 1245 - protein, 6 aa, Artificial Sequence
  Description of Artificial Sequence: Synthetic peptide
LHYPDL

SEQ ID NO: 1246 - protein, 6 aa, Artificial Sequence
  Description of Artificial Sequence: Synthetic peptide
LHYPII

SEQ ID NO: 1247 - protein, 6 aa, Artificial Sequence
  Description of Artificial Sequence: Synthetic peptide
LHYPIL

SEQ ID NO: 1248 - protein, 6 aa, Artificial Sequence
  Description of Artificial Sequence: Synthetic peptide
LHYPLL

SEQ ID NO: 1249 - protein, 6 aa, Artificial Sequence
  Description of Artificial Sequence: Synthetic peptide
LHYPML

SEQ ID NO: 1250 - protein, 6 aa, Artificial Sequence
  Description of Artificial Sequence: Synthetic peptide
LHYPNV

SEQ ID NO: 1251 - protein, 6 aa, Artificial Sequence
  Description of Artificial Sequence: Synthetic peptide
LHYPSI

SEQ ID NO: 1252 - protein, 6 aa, Artificial Sequence
  Description of Artificial Sequence: Synthetic peptide
LHYPTI

SEQ ID NO: 1253 - protein, 6 aa, Artificial Sequence
  Description of Artificial Sequence: Synthetic peptide
LHYPTL

SEQ ID NO: 1254 - protein, 6 aa, Artificial Sequence
  Description of Artificial Sequence: Synthetic peptide
LHYPTV

SEQ ID NO: 1255 - protein, 6 aa, Artificial Sequence
  Description of Artificial Sequence: Synthetic peptide
LHYPVI

SEQ ID NO: 1256 - protein, 6 aa, Artificial Sequence
  Description of Artificial Sequence: Synthetic peptide
LHYPVL

SEQ ID NO: 1257 - protein, 6 aa, Artificial Sequence
  Description of Artificial Sequence: Synthetic peptide
LHYRII

SEQ ID NO: 1258 - protein, 6 aa, Artificial Sequence
  Description of Artificial Sequence: Synthetic peptide
LHYRTI

SEQ ID NO: 1259 - protein, 6 aa, Artificial Sequence
  Description of Artificial Sequence: Synthetic peptide
LHYSII

SEQ ID NO: 1260 - protein, 6 aa, Artificial Sequence
  Description of Artificial Sequence: Synthetic peptide
LHYSSI

SEQ ID NO: 1261 - protein, 6 aa, Artificial Sequence
  Description of Artificial Sequence: Synthetic peptide
LHYSTI

SEQ ID NO: 1262 - protein, 6 aa, Artificial Sequence
  Description of Artificial Sequence: Synthetic peptide
LHYSTL

SEQ ID NO: 1263 - protein, 6 aa, Artificial Sequence
  Description of Artificial Sequence: Synthetic peptide
LHYSVI

SEQ ID NO: 1264 - protein, 6 aa, Artificial Sequence
  Description of Artificial Sequence: Synthetic peptide
LHYTAI

SEQ ID NO: 1265 - protein, 6 aa, Artificial Sequence
  Description of Artificial Sequence: Synthetic peptide
LHYTAL

SEQ ID NO: 1266 - protein, 6 aa, Artificial Sequence
  Description of Artificial Sequence: Synthetic peptide
LHYTII

SEQ ID NO: 1267 - protein, 6 aa, Artificial Sequence
  Description of Artificial Sequence: Synthetic peptide
LHYTKV

SEQ ID NO: 1268 - protein, 6 aa, Artificial Sequence
  Description of Artificial Sequence: Synthetic peptide
LHYTLI

SEQ ID NO: 1269 - protein, 6 aa, Artificial Sequence
  Description of Artificial Sequence: Synthetic peptide
LHYTSI

SEQ ID NO: 1270 - protein, 6 aa, Artificial Sequence
  Description of Artificial Sequence: Synthetic peptide
LHYTTI

SEQ ID NO: 1271 - protein, 6 aa, Artificial Sequence
  Description of Artificial Sequence: Synthetic peptide
LHYTTV

SEQ ID NO: 1272 - protein, 6 aa, Artificial Sequence
  Description of Artificial Sequence: Synthetic peptide
LHYTVI

SEQ ID NO: 1273 - protein, 6 aa, Artificial Sequence
  Description of Artificial Sequence: Synthetic peptide
LHYTVL

SEQ ID NO: 1274 - protein, 6 aa, Artificial Sequence
  Description of Artificial Sequence: Synthetic peptide
LHYTVV

SEQ ID NO: 1275 - protein, 6 aa, Artificial Sequence
  Description of Artificial Sequence: Synthetic peptide
LHYVSI

SEQ ID NO: 1276 - protein, 6 aa, Artificial Sequence
  Description of Artificial Sequence: Synthetic peptide
LHYVTI

SEQ ID NO: 1277 - protein, 6 aa, Artificial Sequence
  Description of Artificial Sequence: Synthetic peptide
LHYVVI

SEQ ID NO: 1278 - protein, 6 aa, Artificial Sequence
  Description of Artificial Sequence: Synthetic peptide
LIYEKL

SEQ ID NO: 1279 - protein, 6 aa, Artificial Sequence
  Description of Artificial Sequence: Synthetic peptide
LIYENV

SEQ ID NO: 1280 - protein, 6 aa, Artificial Sequence
  Description of Artificial Sequence: Synthetic peptide
LIYKDL

SEQ ID NO: 1281 - protein, 6 aa, Artificial Sequence
  Description of Artificial Sequence: Synthetic peptide
LIYNSL

SEQ ID NO: 1282 - protein, 6 aa, Artificial Sequence
  Description of Artificial Sequence: Synthetic peptide
LIYSGL

SEQ ID NO: 1283 - protein, 6 aa, Artificial Sequence
  Description of Artificial Sequence: Synthetic peptide
LIYTLL

SEQ ID NO: 1284 - protein, 6 aa, Artificial Sequence
  Description of Artificial Sequence: Synthetic peptide
LIYTVL

SEQ ID NO: 1285 - protein, 6 aa, Artificial Sequence
  Description of Artificial Sequence: Synthetic peptide
LIYWEI

SEQ ID NO: 1286 - protein, 6 aa, Artificial Sequence
  Description of Artificial Sequence: Synthetic peptide
LKYCEL

SEQ ID NO: 1287 - protein, 6 aa, Artificial Sequence
  Description of Artificial Sequence: Synthetic peptide
LKYDKL

SEQ ID NO: 1288 - protein, 6 aa, Artificial Sequence
  Description of Artificial Sequence: Synthetic peptide
LKYESL

SEQ ID NO: 1289 - protein, 6 aa, Artificial Sequence
  Description of Artificial Sequence: Synthetic peptide
LKYFTI

SEQ ID NO: 1290 - protein, 6 aa, Artificial Sequence
  Description of Artificial Sequence: Synthetic peptide
LKYHTV

SEQ ID NO: 1291 - protein, 6 aa, Artificial Sequence
  Description of Artificial Sequence: Synthetic peptide
LKYILL

SEQ ID NO: 1292 - protein, 6 aa, Artificial Sequence
  Description of Artificial Sequence: Synthetic peptide
LKYIPI

SEQ ID NO: 1293 - protein, 6 aa, Artificial Sequence
  Description of Artificial Sequence: Synthetic peptide
LKYKHV

SEQ ID NO: 1294 - protein, 6 aa, Artificial Sequence
  Description of Artificial Sequence: Synthetic peptide
LKYLYL

SEQ ID NO: 1295 - protein, 6 aa, Artificial Sequence
  Description of Artificial Sequence: Synthetic peptide
LKYMEV

SEQ ID NO: 1296 - protein, 6 aa, Artificial Sequence
  Description of Artificial Sequence: Synthetic peptide
LKYMTL

SEQ ID NO: 1297 - protein, 6 aa, Artificial Sequence
  Description of Artificial Sequence: Synthetic peptide
LKYPAI

SEQ ID NO: 1298 - protein, 6 aa, Artificial Sequence
  Description of Artificial Sequence: Synthetic peptide
LKYPDV

SEQ ID NO: 1299 - protein, 6 aa, Artificial Sequence
  Description of Artificial Sequence: Synthetic peptide
LKYPEL

SEQ ID NO: 1300 - protein, 6 aa, Artificial Sequence
  Description of Artificial Sequence: Synthetic peptide
LKYQPI

SEQ ID NO: 1301 - protein, 6 aa, Artificial Sequence
  Description of Artificial Sequence: Synthetic peptide
LKYRGL

SEQ ID NO: 1302 - protein, 6 aa, Artificial Sequence
  Description of Artificial Sequence: Synthetic peptide
LKYRLL

SEQ ID NO: 1303 - protein, 6 aa, Artificial Sequence
  Description of Artificial Sequence: Synthetic peptide
LLYADL

SEQ ID NO: 1304 - protein, 6 aa, Artificial Sequence
  Description of Artificial Sequence: Synthetic peptide
LLYAPL

SEQ ID NO: 1305 - protein, 6 aa, Artificial Sequence
  Description of Artificial Sequence: Synthetic peptide
LLYAVV

SEQ ID NO: 1306 - protein, 6 aa, Artificial Sequence
  Description of Artificial Sequence: Synthetic peptide
LLYCAI

SEQ ID NO: 1307 - protein, 6 aa, Artificial Sequence
  Description of Artificial Sequence: Synthetic peptide
LLYEHV

SEQ ID NO: 1308 - protein, 6 aa, Artificial Sequence
  Description of Artificial Sequence: Synthetic peptide
LLYELL

SEQ ID NO: 1309 - protein, 6 aa, Artificial Sequence
  Description of Artificial Sequence: Synthetic peptide
LLYEQL

SEQ ID NO: 1310 - protein, 6 aa, Artificial Sequence
  Description of Artificial Sequence: Synthetic peptide
LLYGQI

SEQ ID NO: 1311 - protein, 6 aa, Artificial Sequence
  Description of Artificial Sequence: Synthetic peptide
LLYIRL

SEQ ID NO: 1312 - protein, 6 aa, Artificial Sequence
  Description of Artificial Sequence: Synthetic peptide
LLYKAL

SEQ ID NO: 1313 - protein, 6 aa, Artificial Sequence
  Description of Artificial Sequence: Synthetic peptide
LLYKFL

SEQ ID NO: 1314 - protein, 6 aa, Artificial Sequence
  Description of Artificial Sequence: Synthetic peptide
LLYKLL

SEQ ID NO: 1315 - protein, 6 aa, Artificial Sequence
  Description of Artificial Sequence: Synthetic peptide
LLYKTV

SEQ ID NO: 1316 - protein, 6 aa, Artificial Sequence
  Description of Artificial Sequence: Synthetic peptide
LLYMVV

SEQ ID NO: 1317 - protein, 6 aa, Artificial Sequence
  Description of Artificial Sequence: Synthetic peptide
LLYNAI

SEQ ID NO: 1318 - protein, 6 aa, Artificial Sequence
  Description of Artificial Sequence: Synthetic peptide
LLYNIV

SEQ ID NO: 1319 - protein, 6 aa, Artificial Sequence
  Description of Artificial Sequence: Synthetic peptide
LLYNVI

SEQ ID NO: 1320 - protein, 6 aa, Artificial Sequence
  Description of Artificial Sequence: Synthetic peptide
LLYPAI

SEQ ID NO: 1321 - protein, 6 aa, Artificial Sequence
  Description of Artificial Sequence: Synthetic peptide
LLYPLI

SEQ ID NO: 1322 - protein, 6 aa, Artificial Sequence
  Description of Artificial Sequence: Synthetic peptide
LLYPNI

SEQ ID NO: 1323 - protein, 6 aa, Artificial Sequence
  Description of Artificial Sequence: Synthetic peptide
LLYPSL

SEQ ID NO: 1324 - protein, 6 aa, Artificial Sequence
  Description of Artificial Sequence: Synthetic peptide
LLYPTI

SEQ ID NO: 1325 - protein, 6 aa, Artificial Sequence
  Description of Artificial Sequence: Synthetic peptide
LLYPVI

SEQ ID NO: 1326 - protein, 6 aa, Artificial Sequence
  Description of Artificial Sequence: Synthetic peptide
LLYPVV

SEQ ID NO: 1327 - protein, 6 aa, Artificial Sequence
  Description of Artificial Sequence: Synthetic peptide
LLYQIL

SEQ ID NO: 1328 - protein, 6 aa, Artificial Sequence
  Description of Artificial Sequence: Synthetic peptide
LLYQNI

SEQ ID NO: 1329 - protein, 6 aa, Artificial Sequence
  Description of Artificial Sequence: Synthetic peptide
LLYRLL

SEQ ID NO: 1330 - protein, 6 aa, Artificial Sequence
  Description of Artificial Sequence: Synthetic peptide
LLYRVI

SEQ ID NO: 1331 - protein, 6 aa, Artificial Sequence
  Description of Artificial Sequence: Synthetic peptide
LLYSII

SEQ ID NO: 1332 - protein, 6 aa, Artificial Sequence
  Description of Artificial Sequence: Synthetic peptide
LLYSLI

SEQ ID NO: 1333 - protein, 6 aa, Artificial Sequence
  Description of Artificial Sequence: Synthetic peptide
LLYSPV

SEQ ID NO: 1334 - protein, 6 aa, Artificial Sequence
  Description of Artificial Sequence: Synthetic peptide
LLYSRL

SEQ ID NO: 1335 - protein, 6 aa, Artificial Sequence
  Description of Artificial Sequence: Synthetic peptide
LLYSTI

SEQ ID NO: 1336 - protein, 6 aa, Artificial Sequence
  Description of Artificial Sequence: Synthetic peptide
LLYSVI

SEQ ID NO: 1337 - protein, 6 aa, Artificial Sequence
  Description of Artificial Sequence: Synthetic peptide
LLYSVV

SEQ ID NO: 1338 - protein, 6 aa, Artificial Sequence
  Description of Artificial Sequence: Synthetic peptide
LLYTTI

SEQ ID NO: 1339 - protein, 6 aa, Artificial Sequence
  Description of Artificial Sequence: Synthetic peptide
LLYTVI

SEQ ID NO: 1340 - protein, 6 aa, Artificial Sequence
  Description of Artificial Sequence: Synthetic peptide
LLYTVV

SEQ ID NO: 1341 - protein, 6 aa, Artificial Sequence
  Description of Artificial Sequence: Synthetic peptide
LLYVII

SEQ ID NO: 1342 - protein, 6 aa, Artificial Sequence
  Description of Artificial Sequence: Synthetic peptide
LLYVIL

SEQ ID NO: 1343 - protein, 6 aa, Artificial Sequence
  Description of Artificial Sequence: Synthetic peptide
LLYVTI

SEQ ID NO: 1344 - protein, 6 aa, Artificial Sequence
  Description of Artificial Sequence: Synthetic peptide
LLYWGI

SEQ ID NO: 1345 - protein, 6 aa, Artificial Sequence
  Description of Artificial Sequence: Synthetic peptide
LLYYLL

SEQ ID NO: 1346 - protein, 6 aa, Artificial Sequence
  Description of Artificial Sequence: Synthetic peptide
LLYYVI

SEQ ID NO: 1347 - protein, 6 aa, Artificial Sequence
  Description of Artificial Sequence: Synthetic peptide
LMYDNV

SEQ ID NO: 1348 - protein, 6 aa, Artificial Sequence
  Description of Artificial Sequence: Synthetic peptide
LMYMVV

SEQ ID NO: 1349 - protein, 6 aa, Artificial Sequence
  Description of Artificial Sequence: Synthetic peptide
LMYQEL

SEQ ID NO: 1350 - protein, 6 aa, Artificial Sequence
  Description of Artificial Sequence: Synthetic peptide
LMYRGI

SEQ ID NO: 1351 - protein, 6 aa, Artificial Sequence
  Description of Artificial Sequence: Synthetic peptide
LNYACL

SEQ ID NO: 1352 - protein, 6 aa, Artificial Sequence
  Description of Artificial Sequence: Synthetic peptide
LNYATI

SEQ ID NO: 1353 - protein, 6 aa, Artificial Sequence
  Description of Artificial Sequence: Synthetic peptide
LNYEVI

SEQ ID NO: 1354 - protein, 6 aa, Artificial Sequence
  Description of Artificial Sequence: Synthetic peptide
LNYGDL

SEQ ID NO: 1355 - protein, 6 aa, Artificial Sequence
  Description of Artificial Sequence: Synthetic peptide
LNYHKL

SEQ ID NO: 1356 - protein, 6 aa, Artificial Sequence
  Description of Artificial Sequence: Synthetic peptide
LNYMVL

SEQ ID NO: 1357 - protein, 6 aa, Artificial Sequence
  Description of Artificial Sequence: Synthetic peptide
LNYNIV

SEQ ID NO: 1358 - protein, 6 aa, Artificial Sequence
  Description of Artificial Sequence: Synthetic peptide
LNYPVI

SEQ ID NO: 1359 - protein, 6 aa, Artificial Sequence
  Description of Artificial Sequence: Synthetic peptide
LNYQMI

SEQ ID NO: 1360 - protein, 6 aa, Artificial Sequence
  Description of Artificial Sequence: Synthetic peptide
LNYSGV

SEQ ID NO: 1361 - protein, 6 aa, Artificial Sequence
  Description of Artificial Sequence: Synthetic peptide
LNYSVI

SEQ ID NO: 1362 - protein, 6 aa, Artificial Sequence
  Description of Artificial Sequence: Synthetic peptide
LNYTIL

SEQ ID NO: 1363 - protein, 6 aa, Artificial Sequence
  Description of Artificial Sequence: Synthetic peptide
LNYTTI

SEQ ID NO: 1364 - protein, 6 aa, Artificial Sequence
  Description of Artificial Sequence: Synthetic peptide
LNYVPI

SEQ ID NO: 1365 - protein, 6 aa, Artificial Sequence
  Description of Artificial Sequence: Synthetic peptide
LPYADL

SEQ ID NO: 1366 - protein, 6 aa, Artificial Sequence
  Description of Artificial Sequence: Synthetic peptide
LPYALL

SEQ ID NO: 1367 - protein, 6 aa, Artificial Sequence
  Description of Artificial Sequence: Synthetic peptide
LPYFNI

SEQ ID NO: 1368 - protein, 6 aa, Artificial Sequence
  Description of Artificial Sequence: Synthetic peptide
LPYFNV

SEQ ID NO: 1369 - protein, 6 aa, Artificial Sequence
  Description of Artificial Sequence: Synthetic peptide
LPYHDL

SEQ ID NO: 1370 - protein, 6 aa, Artificial Sequence
  Description of Artificial Sequence: Synthetic peptide
LPYKLI

SEQ ID NO: 1371 - protein, 6 aa, Artificial Sequence
  Description of Artificial Sequence: Synthetic peptide
LPYKTL

SEQ ID NO: 1372 - protein, 6 aa, Artificial Sequence
  Description of Artificial Sequence: Synthetic peptide
LPYLGV

SEQ ID NO: 1373 - protein, 6 aa, Artificial Sequence
  Description of Artificial Sequence: Synthetic peptide
LPYLKV

SEQ ID NO: 1374 - protein, 6 aa, Artificial Sequence
  Description of Artificial Sequence: Synthetic peptide
LPYPAL

SEQ ID NO: 1375 - protein, 6 aa, Artificial Sequence
  Description of Artificial Sequence: Synthetic peptide
LPYQVV

SEQ ID NO: 1376 - protein, 6 aa, Artificial Sequence
  Description of Artificial Sequence: Synthetic peptide
LPYRTV

SEQ ID NO: 1377 - protein, 6 aa, Artificial Sequence
  Description of Artificial Sequence: Synthetic peptide
LPYVEI

SEQ ID NO: 1378 - protein, 6 aa, Artificial Sequence
  Description of Artificial Sequence: Synthetic peptide
LPYYDL

SEQ ID NO: 1379 - protein, 6 aa, Artificial Sequence
  Description of Artificial Sequence: Synthetic peptide
LQYASL

SEQ ID NO: 1380 - protein, 6 aa, Artificial Sequence
  Description of Artificial Sequence: Synthetic peptide
LQYERI

SEQ ID NO: 1381 - protein, 6 aa, Artificial Sequence
  Description of Artificial Sequence: Synthetic peptide
LQYFAV

SEQ ID NO: 1382 - protein, 6 aa, Artificial Sequence
  Description of Artificial Sequence: Synthetic peptide
LQYFSI

SEQ ID NO: 1383 - protein, 6 aa, Artificial Sequence
  Description of Artificial Sequence: Synthetic peptide
LQYHNI

SEQ ID NO: 1384 - protein, 6 aa, Artificial Sequence
  Description of Artificial Sequence: Synthetic peptide
LQYIGL

SEQ ID NO: 1385 - protein, 6 aa, Artificial Sequence
  Description of Artificial Sequence: Synthetic peptide
LQYIKI

SEQ ID NO: 1386 - protein, 6 aa, Artificial Sequence
  Description of Artificial Sequence: Synthetic peptide
LQYLSL

SEQ ID NO: 1387 - protein, 6 aa, Artificial Sequence
  Description of Artificial Sequence: Synthetic peptide
LQYMIV

SEQ ID NO: 1388 - protein, 6 aa, Artificial Sequence
  Description of Artificial Sequence: Synthetic peptide
LQYPAI

SEQ ID NO: 1389 - protein, 6 aa, Artificial Sequence
  Description of Artificial Sequence: Synthetic peptide
LQYPLL

SEQ ID NO: 1390 - protein, 6 aa, Artificial Sequence
  Description of Artificial Sequence: Synthetic peptide
LQYPLV

SEQ ID NO: 1391 - protein, 6 aa, Artificial Sequence
  Description of Artificial Sequence: Synthetic peptide
LQYPSI

SEQ ID NO: 1392 - protein, 6 aa, Artificial Sequence
  Description of Artificial Sequence: Synthetic peptide
LQYPTL

SEQ ID NO: 1393 - protein, 6 aa, Artificial Sequence
  Description of Artificial Sequence: Synthetic peptide
LQYPVL

SEQ ID NO: 1394 - protein, 6 aa, Artificial Sequence
  Description of Artificial Sequence: Synthetic peptide
LQYRAV

SEQ ID NO: 1395 - protein, 6 aa, Artificial Sequence
  Description of Artificial Sequence: Synthetic peptide
LQYSAI

SEQ ID NO: 1396 - protein, 6 aa, Artificial Sequence
  Description of Artificial Sequence: Synthetic peptide
LQYSSI

SEQ ID NO: 1397 - protein, 6 aa, Artificial Sequence
  Description of Artificial Sequence: Synthetic peptide
LQYSVI

SEQ ID NO: 1398 - protein, 6 aa, Artificial Sequence
  Description of Artificial Sequence: Synthetic peptide
LQYTIL

SEQ ID NO: 1399 - protein, 6 aa, Artificial Sequence
  Description of Artificial Sequence: Synthetic peptide
LQYTLI

SEQ ID NO: 1400 - protein, 6 aa, Artificial Sequence
  Description of Artificial Sequence: Synthetic peptide
LQYTMI

SEQ ID NO: 1401 - protein, 6 aa, Artificial Sequence
  Description of Artificial Sequence: Synthetic peptide
LQYYQV

SEQ ID NO: 1402 - protein, 6 aa, Artificial Sequence
  Description of Artificial Sequence: Synthetic peptide
LRYAAV

SEQ ID NO: 1403 - protein, 6 aa, Artificial Sequence
  Description of Artificial Sequence: Synthetic peptide
LRYAGL

SEQ ID NO: 1404 - protein, 6 aa, Artificial Sequence
  Description of Artificial Sequence: Synthetic peptide
LRYAPL

SEQ ID NO: 1405 - protein, 6 aa, Artificial Sequence
  Description of Artificial Sequence: Synthetic peptide
LRYASI

SEQ ID NO: 1406 - protein, 6 aa, Artificial Sequence
  Description of Artificial Sequence: Synthetic peptide
LRYATI

SEQ ID NO: 1407 - protein, 6 aa, Artificial Sequence
  Description of Artificial Sequence: Synthetic peptide
LRYATV

SEQ ID NO: 1408 - protein, 6 aa, Artificial Sequence
  Description of Artificial Sequence: Synthetic peptide
LRYAVL

SEQ ID NO: 1409 - protein, 6 aa, Artificial Sequence
  Description of Artificial Sequence: Synthetic peptide
LRYCGI

SEQ ID NO: 1410 - protein, 6 aa, Artificial Sequence
  Description of Artificial Sequence: Synthetic peptide
LRYELL

SEQ ID NO: 1411 - protein, 6 aa, Artificial Sequence
  Description of Artificial Sequence: Synthetic peptide
LRYETL

SEQ ID NO: 1412 - protein, 6 aa, Artificial Sequence
  Description of Artificial Sequence: Synthetic peptide
LRYGAL

SEQ ID NO: 1413 - protein, 6 aa, Artificial Sequence
  Description of Artificial Sequence: Synthetic peptide
LRYGPI

SEQ ID NO: 1414 - protein, 6 aa, Artificial Sequence
  Description of Artificial Sequence: Synthetic peptide
LRYGTL

SEQ ID NO: 1415 - protein, 6 aa, Artificial Sequence
  Description of Artificial Sequence: Synthetic peptide
LRYHHI

SEQ ID NO: 1416 - protein, 6 aa, Artificial Sequence
  Description of Artificial Sequence: Synthetic peptide
LRYHSI

SEQ ID NO: 1417 - protein, 6 aa, Artificial Sequence
  Description of Artificial Sequence: Synthetic peptide
LRYHVL

SEQ ID NO: 1418 - protein, 6 aa, Artificial Sequence
  Description of Artificial Sequence: Synthetic peptide
LRYIAI

SEQ ID NO: 1419 - protein, 6 aa, Artificial Sequence
  Description of Artificial Sequence: Synthetic peptide
LRYIFV

SEQ ID NO: 1420 - protein, 6 aa, Artificial Sequence
  Description of Artificial Sequence: Synthetic peptide
LRYITV

SEQ ID NO: 1421 - protein, 6 aa, Artificial Sequence
  Description of Artificial Sequence: Synthetic peptide
LRYKEV

SEQ ID NO: 1422 - protein, 6 aa, Artificial Sequence
  Description of Artificial Sequence: Synthetic peptide
LRYKKL

SEQ ID NO: 1423 - protein, 6 aa, Artificial Sequence
  Description of Artificial Sequence: Synthetic peptide
LRYKMV

SEQ ID NO: 1424 - protein, 6 aa, Artificial Sequence
  Description of Artificial Sequence: Synthetic peptide
LRYKSL

SEQ ID NO: 1425 - protein, 6 aa, Artificial Sequence
  Description of Artificial Sequence: Synthetic peptide
LRYKVI

SEQ ID NO: 1426 - protein, 6 aa, Artificial Sequence
  Description of Artificial Sequence: Synthetic peptide
LRYLAI

SEQ ID NO: 1427 - protein, 6 aa, Artificial Sequence
  Description of Artificial Sequence: Synthetic peptide
LRYLDL

SEQ ID NO: 1428 - protein, 6 aa, Artificial Sequence
  Description of Artificial Sequence: Synthetic peptide
LRYLTI

SEQ ID NO: 1429 - protein, 6 aa, Artificial Sequence
  Description of Artificial Sequence: Synthetic peptide
LRYLTV

SEQ ID NO: 1430 - protein, 6 aa, Artificial Sequence
  Description of Artificial Sequence: Synthetic peptide
LRYMSI

SEQ ID NO: 1431 - protein, 6 aa, Artificial Sequence
  Description of Artificial Sequence: Synthetic peptide
LRYMVI

SEQ ID NO: 1432 - protein, 6 aa, Artificial Sequence
  Description of Artificial Sequence: Synthetic peptide
LRYNCI

SEQ ID NO: 1433 - protein, 6 aa, Artificial Sequence
  Description of Artificial Sequence: Synthetic peptide
LRYNGL

SEQ ID NO: 1434 - protein, 6 aa, Artificial Sequence
  Description of Artificial Sequence: Synthetic peptide
LRYNII

SEQ ID NO: 1435 - protein, 6 aa, Artificial Sequence
  Description of Artificial Sequence: Synthetic peptide
LRYNIL

SEQ ID NO: 1436 - protein, 6 aa, Artificial Sequence
  Description of Artificial Sequence: Synthetic peptide
LRYNKI

SEQ ID NO: 1437 - protein, 6 aa, Artificial Sequence
  Description of Artificial Sequence: Synthetic peptide
LRYNSL

SEQ ID NO: 1438 - protein, 6 aa, Artificial Sequence
  Description of Artificial Sequence: Synthetic peptide
LRYNVI

SEQ ID NO: 1439 - protein, 6 aa, Artificial Sequence
  Description of Artificial Sequence: Synthetic peptide
LRYNVL

SEQ ID NO: 1440 - protein, 6 aa, Artificial Sequence
  Description of Artificial Sequence: Synthetic peptide
LRYPFL

SEQ ID NO: 1441 - protein, 6 aa, Artificial Sequence
  Description of Artificial Sequence: Synthetic peptide
LRYPII

SEQ ID NO: 1442 - protein, 6 aa, Artificial Sequence
  Description of Artificial Sequence: Synthetic peptide
LRYPIL

SEQ ID NO: 1443 - protein, 6 aa, Artificial Sequence
  Description of Artificial Sequence: Synthetic peptide
LRYPLL

SEQ ID NO: 1444 - protein, 6 aa, Artificial Sequence
  Description of Artificial Sequence: Synthetic peptide
LRYPNI

SEQ ID NO: 1445 - protein, 6 aa, Artificial Sequence
  Description of Artificial Sequence: Synthetic peptide
LRYPSI

SEQ ID NO: 1446 - protein, 6 aa, Artificial Sequence
  Description of Artificial Sequence: Synthetic peptide
LRYPTI

SEQ ID NO: 1447 - protein, 6 aa, Artificial Sequence
  Description of Artificial Sequence: Synthetic peptide
LRYPTL

SEQ ID NO: 1448 - protein, 6 aa, Artificial Sequence
  Description of Artificial Sequence: Synthetic peptide
LRYPVI

SEQ ID NO: 1449 - protein, 6 aa, Artificial Sequence
  Description of Artificial Sequence: Synthetic peptide
LRYPVL

SEQ ID NO: 1450 - protein, 6 aa, Artificial Sequence
  Description of Artificial Sequence: Synthetic peptide
LRYQKL

SEQ ID NO: 1451 - protein, 6 aa, Artificial Sequence
  Description of Artificial Sequence: Synthetic peptide
LRYQMI

SEQ ID NO: 1452 - protein, 6 aa, Artificial Sequence
  Description of Artificial Sequence: Synthetic peptide
LRYQNL

SEQ ID NO: 1453 - protein, 6 aa, Artificial Sequence
  Description of Artificial Sequence: Synthetic peptide
LRYRLI

SEQ ID NO: 1454 - protein, 6 aa, Artificial Sequence
  Description of Artificial Sequence: Synthetic peptide
LRYRVI

SEQ ID NO: 1455 - protein, 6 aa, Artificial Sequence
  Description of Artificial Sequence: Synthetic peptide
LRYSAI

SEQ ID NO: 1456 - protein, 6 aa, Artificial Sequence
  Description of Artificial Sequence: Synthetic peptide
LRYSDL

SEQ ID NO: 1457 - protein, 6 aa, Artificial Sequence
  Description of Artificial Sequence: Synthetic peptide
LRYSII

SEQ ID NO: 1458 - protein, 6 aa, Artificial Sequence
  Description of Artificial Sequence: Synthetic peptide
LRYSMI

SEQ ID NO: 1459 - protein, 6 aa, Artificial Sequence
  Description of Artificial Sequence: Synthetic peptide
LRYSSI

SEQ ID NO: 1460 - protein, 6 aa, Artificial Sequence
  Description of Artificial Sequence: Synthetic peptide
LRYSTI

SEQ ID NO: 1461 - protein, 6 aa, Artificial Sequence
  Description of Artificial Sequence: Synthetic peptide
LRYSTL

SEQ ID NO: 1462 - protein, 6 aa, Artificial Sequence
  Description of Artificial Sequence: Synthetic peptide
LRYSVI

SEQ ID NO: 1463 - protein, 6 aa, Artificial Sequence
  Description of Artificial Sequence: Synthetic peptide
LRYSVL

SEQ ID NO: 1464 - protein, 6 aa, Artificial Sequence
  Description of Artificial Sequence: Synthetic peptide
LRYSVV

SEQ ID NO: 1465 - protein, 6 aa, Artificial Sequence
  Description of Artificial Sequence: Synthetic peptide
LRYTAI

SEQ ID NO: 1466 - protein, 6 aa, Artificial Sequence
  Description of Artificial Sequence: Synthetic peptide
LRYTIL

SEQ ID NO: 1467 - protein, 6 aa, Artificial Sequence
  Description of Artificial Sequence: Synthetic peptide
LRYTLI

SEQ ID NO: 1468 - protein, 6 aa, Artificial Sequence
  Description of Artificial Sequence: Synthetic peptide
LRYTMI

SEQ ID NO: 1469 - protein, 6 aa, Artificial Sequence
  Description of Artificial Sequence: Synthetic peptide
LRYTNL

SEQ ID NO: 1470 - protein, 6 aa, Artificial Sequence
  Description of Artificial Sequence: Synthetic peptide
LRYTPV

SEQ ID NO: 1471 - protein, 6 aa, Artificial Sequence
  Description of Artificial Sequence: Synthetic peptide
LRYTSI

SEQ ID NO: 1472 - protein, 6 aa, Artificial Sequence
  Description of Artificial Sequence: Synthetic peptide
LRYTSV

SEQ ID NO: 1473 - protein, 6 aa, Artificial Sequence
  Description of Artificial Sequence: Synthetic peptide
LRYTTI

SEQ ID NO: 1474 - protein, 6 aa, Artificial Sequence
  Description of Artificial Sequence: Synthetic peptide
LRYTTV

SEQ ID NO: 1475 - protein, 6 aa, Artificial Sequence
  Description of Artificial Sequence: Synthetic peptide
LRYTVI

SEQ ID NO: 1476 - protein, 6 aa, Artificial Sequence
  Description of Artificial Sequence: Synthetic peptide
LRYVEV

SEQ ID NO: 1477 - protein, 6 aa, Artificial Sequence
  Description of Artificial Sequence: Synthetic peptide
LRYVTI

SEQ ID NO: 1478 - protein, 6 aa, Artificial Sequence
  Description of Artificial Sequence: Synthetic peptide
LRYVTV

SEQ ID NO: 1479 - protein, 6 aa, Artificial Sequence
  Description of Artificial Sequence: Synthetic peptide
LSYDSL

SEQ ID NO: 1480 - protein, 6 aa, Artificial Sequence
  Description of Artificial Sequence: Synthetic peptide
LSYEDV

SEQ ID NO: 1481 - protein, 6 aa, Artificial Sequence
  Description of Artificial Sequence: Synthetic peptide
LSYFGV

SEQ ID NO: 1482 - protein, 6 aa, Artificial Sequence
  Description of Artificial Sequence: Synthetic peptide
LSYILI

SEQ ID NO: 1483 - protein, 6 aa, Artificial Sequence
  Description of Artificial Sequence: Synthetic peptide
LSYISV

SEQ ID NO: 1484 - protein, 6 aa, Artificial Sequence
  Description of Artificial Sequence: Synthetic peptide
LSYKQV

SEQ ID NO: 1485 - protein, 6 aa, Artificial Sequence
  Description of Artificial Sequence: Synthetic peptide
LSYKRL

SEQ ID NO: 1486 - protein, 6 aa, Artificial Sequence
  Description of Artificial Sequence: Synthetic peptide
LSYLDV

SEQ ID NO: 1487 - protein, 6 aa, Artificial Sequence
  Description of Artificial Sequence: Synthetic peptide
LSYMDL

SEQ ID NO: 1488 - protein, 6 aa, Artificial Sequence
  Description of Artificial Sequence: Synthetic peptide
LSYNAL

SEQ ID NO: 1489 - protein, 6 aa, Artificial Sequence
  Description of Artificial Sequence: Synthetic peptide
LSYNDL

SEQ ID NO: 1490 - protein, 6 aa, Artificial Sequence
  Description of Artificial Sequence: Synthetic peptide
LSYNKL

SEQ ID NO: 1491 - protein, 6 aa, Artificial Sequence
  Description of Artificial Sequence: Synthetic peptide
LSYNQL

SEQ ID NO: 1492 - protein, 6 aa, Artificial Sequence
  Description of Artificial Sequence: Synthetic peptide
LSYPVL

SEQ ID NO: 1493 - protein, 6 aa, Artificial Sequence
  Description of Artificial Sequence: Synthetic peptide
LSYQEV

SEQ ID NO: 1494 - protein, 6 aa, Artificial Sequence
  Description of Artificial Sequence: Synthetic peptide
LSYQPV

SEQ ID NO: 1495 - protein, 6 aa, Artificial Sequence
  Description of Artificial Sequence: Synthetic peptide
LSYQTI

SEQ ID NO: 1496 - protein, 6 aa, Artificial Sequence
  Description of Artificial Sequence: Synthetic peptide
LSYRSL

SEQ ID NO: 1497 - protein, 6 aa, Artificial Sequence
  Description of Artificial Sequence: Synthetic peptide
LSYRSV

SEQ ID NO: 1498 - protein, 6 aa, Artificial Sequence
  Description of Artificial Sequence: Synthetic peptide
LSYSII

SEQ ID NO: 1499 - protein, 6 aa, Artificial Sequence
  Description of Artificial Sequence: Synthetic peptide
LSYSSL

SEQ ID NO: 1500 - protein, 6 aa, Artificial Sequence
  Description of Artificial Sequence: Synthetic peptide
LSYSTL

SEQ ID NO: 1501 - protein, 6 aa, Artificial Sequence
  Description of Artificial Sequence: Synthetic peptide
LSYTKV

SEQ ID NO: 1502 - protein, 6 aa, Artificial Sequence
  Description of Artificial Sequence: Synthetic peptide
LSYTSI

SEQ ID NO: 1503 - protein, 6 aa, Artificial Sequence
  Description of Artificial Sequence: Synthetic peptide
LSYTTI

SEQ ID NO: 1504 - protein, 6 aa, Artificial Sequence
  Description of Artificial Sequence: Synthetic peptide
LSYVLI

SEQ ID NO: 1505 - protein, 6 aa, Artificial Sequence
  Description of Artificial Sequence: Synthetic peptide
LTYADL

SEQ ID NO: 1506 - protein, 6 aa, Artificial Sequence
  Description of Artificial Sequence: Synthetic peptide
LTYAEL

SEQ ID NO: 1507 - protein, 6 aa, Artificial Sequence
  Description of Artificial Sequence: Synthetic peptide
LTYAQV

SEQ ID NO: 1508 - protein, 6 aa, Artificial Sequence
  Description of Artificial Sequence: Synthetic peptide
LTYARL

SEQ ID NO: 1509 - protein, 6 aa, Artificial Sequence
  Description of Artificial Sequence: Synthetic peptide
LTYCDL

SEQ ID NO: 1510 - protein, 6 aa, Artificial Sequence
  Description of Artificial Sequence: Synthetic peptide
LTYCGL

SEQ ID NO: 1511 - protein, 6 aa, Artificial Sequence
  Description of Artificial Sequence: Synthetic peptide
LTYCVL

SEQ ID NO: 1512 - protein, 6 aa, Artificial Sequence
  Description of Artificial Sequence: Synthetic peptide
LTYEEL

SEQ ID NO: 1513 - protein, 6 aa, Artificial Sequence
  Description of Artificial Sequence: Synthetic peptide
LTYEFL

SEQ ID NO: 1514 - protein, 6 aa, Artificial Sequence
  Description of Artificial Sequence: Synthetic peptide
LTYGEV

SEQ ID NO: 1515 - protein, 6 aa, Artificial Sequence
  Description of Artificial Sequence: Synthetic peptide
LTYGRL

SEQ ID NO: 1516 - protein, 6 aa, Artificial Sequence
  Description of Artificial Sequence: Synthetic peptide
LTYKAL

SEQ ID NO: 1517 - protein, 6 aa, Artificial Sequence
  Description of Artificial Sequence: Synthetic peptide
LTYLRL

SEQ ID NO: 1518 - protein, 6 aa, Artificial Sequence
  Description of Artificial Sequence: Synthetic peptide
LTYMTL

SEQ ID NO: 1519 - protein, 6 aa, Artificial Sequence
  Description of Artificial Sequence: Synthetic peptide
LTYNTL

SEQ ID NO: 1520 - protein, 6 aa, Artificial Sequence
  Description of Artificial Sequence: Synthetic peptide
LTYPGI

SEQ ID NO: 1521 - protein, 6 aa, Artificial Sequence
  Description of Artificial Sequence: Synthetic peptide
LTYQSV

SEQ ID NO: 1522 - protein, 6 aa, Artificial Sequence
  Description of Artificial Sequence: Synthetic peptide
LTYSSV

SEQ ID NO: 1523 - protein, 6 aa, Artificial Sequence
  Description of Artificial Sequence: Synthetic peptide
LTYTTV

SEQ ID NO: 1524 - protein, 6 aa, Artificial Sequence
  Description of Artificial Sequence: Synthetic peptide
LVYDAI

SEQ ID NO: 1525 - protein, 6 aa, Artificial Sequence
  Description of Artificial Sequence: Synthetic peptide
LVYDKL

SEQ ID NO: 1526 - protein, 6 aa, Artificial Sequence
  Description of Artificial Sequence: Synthetic peptide
LVYDLV

SEQ ID NO: 1527 - protein, 6 aa, Artificial Sequence
  Description of Artificial Sequence: Synthetic peptide
LVYENL

SEQ ID NO: 1528 - protein, 6 aa, Artificial Sequence
  Description of Artificial Sequence: Synthetic peptide
LVYGQL

SEQ ID NO: 1529 - protein, 6 aa, Artificial Sequence
  Description of Artificial Sequence: Synthetic peptide
LVYHKL

SEQ ID NO: 1530 - protein, 6 aa, Artificial Sequence
  Description of Artificial Sequence: Synthetic peptide
LVYQEV

SEQ ID NO: 1531 - protein, 6 aa, Artificial Sequence
  Description of Artificial Sequence: Synthetic peptide
LVYRKV

SEQ ID NO: 1532 - protein, 6 aa, Artificial Sequence
  Description of Artificial Sequence: Synthetic peptide
LVYRNL

SEQ ID NO: 1533 - protein, 6 aa, Artificial Sequence
  Description of Artificial Sequence: Synthetic peptide
LVYSEI

SEQ ID NO: 1534 - protein, 6 aa, Artificial Sequence
  Description of Artificial Sequence: Synthetic peptide
LVYTNV

SEQ ID NO: 1535 - protein, 6 aa, Artificial Sequence
  Description of Artificial Sequence: Synthetic peptide
LVYWEI

SEQ ID NO: 1536 - protein, 6 aa, Artificial Sequence
  Description of Artificial Sequence: Synthetic peptide
LVYWKL

SEQ ID NO: 1537 - protein, 6 aa, Artificial Sequence
  Description of Artificial Sequence: Synthetic peptide
LVYWRL

SEQ ID NO: 1538 - protein, 6 aa, Artificial Sequence
  Description of Artificial Sequence: Synthetic peptide
LWYEGL

SEQ ID NO: 1539 - protein, 6 aa, Artificial Sequence
  Description of Artificial Sequence: Synthetic peptide
LWYKYI

SEQ ID NO: 1540 - protein, 6 aa, Artificial Sequence
  Description of Artificial Sequence: Synthetic peptide
LWYNHI

SEQ ID NO: 1541 - protein, 6 aa, Artificial Sequence
  Description of Artificial Sequence: Synthetic peptide
LWYTMI

SEQ ID NO: 1542 - protein, 6 aa, Artificial Sequence
  Description of Artificial Sequence: Synthetic peptide
LYYCQL

SEQ ID NO: 1543 - protein, 6 aa, Artificial Sequence
  Description of Artificial Sequence: Synthetic peptide
LYYGDL

SEQ ID NO: 1544 - protein, 6 aa, Artificial Sequence
  Description of Artificial Sequence: Synthetic peptide
LYYKKV

SEQ ID NO: 1545 - protein, 6 aa, Artificial Sequence
  Description of Artificial Sequence: Synthetic peptide
LYYLLI

SEQ ID NO: 1546 - protein, 6 aa, Artificial Sequence
  Description of Artificial Sequence: Synthetic peptide
LYYPKV

SEQ ID NO: 1547 - protein, 6 aa, Artificial Sequence
  Description of Artificial Sequence: Synthetic peptide
LYYRRV

SEQ ID NO: 1548 - protein, 6 aa, Artificial Sequence
  Description of Artificial Sequence: Synthetic peptide
LYYSTI

SEQ ID NO: 1549 - protein, 6 aa, Artificial Sequence
  Description of Artificial Sequence: Synthetic peptide
LYYVRI

SEQ ID NO: 1550 - protein, 6 aa, Artificial Sequence
  Description of Artificial Sequence: Synthetic peptide
LYYVVI

SEQ ID NO: 1551 - protein, 6 aa, Artificial Sequence
  Description of Artificial Sequence: Synthetic peptide
SAYATL

SEQ ID NO: 1552 - protein, 6 aa, Artificial Sequence
  Description of Artificial Sequence: Synthetic peptide
SAYCPL

SEQ ID NO: 1553 - protein, 6 aa, Artificial Sequence
  Description of Artificial Sequence: Synthetic peptide
SAYPAL

SEQ ID NO: 1554 - protein, 6 aa, Artificial Sequence
  Description of Artificial Sequence: Synthetic peptide
SAYQAL

SEQ ID NO: 1555 - protein, 6 aa, Artificial Sequence
  Description of Artificial Sequence: Synthetic peptide
SAYQTI

SEQ ID NO: 1556 - protein, 6 aa, Artificial Sequence
  Description of Artificial Sequence: Synthetic peptide
SAYRSV

SEQ ID NO: 1557 - protein, 6 aa, Artificial Sequence
  Description of Artificial Sequence: Synthetic peptide
SAYTAL

SEQ ID NO: 1558 - protein, 6 aa, Artificial Sequence
  Description of Artificial Sequence: Synthetic peptide
SAYTPL

SEQ ID NO: 1559 - protein, 6 aa, Artificial Sequence
  Description of Artificial Sequence: Synthetic peptide
SAYVVL

SEQ ID NO: 1560 - protein, 6 aa, Artificial Sequence
  Description of Artificial Sequence: Synthetic peptide
SCYAAV

SEQ ID NO: 1561 - protein, 6 aa, Artificial Sequence
  Description of Artificial Sequence: Synthetic peptide
SCYCII

SEQ ID NO: 1562 - protein, 6 aa, Artificial Sequence
  Description of Artificial Sequence: Synthetic peptide
SCYCLL

SEQ ID NO: 1563 - protein, 6 aa, Artificial Sequence
  Description of Artificial Sequence: Synthetic peptide
SCYDFL

SEQ ID NO: 1564 - protein, 6 aa, Artificial Sequence
  Description of Artificial Sequence: Synthetic peptide
SCYEEL

SEQ ID NO: 1565 - protein, 6 aa, Artificial Sequence
  Description of Artificial Sequence: Synthetic peptide
SCYEKI

SEQ ID NO: 1566 - protein, 6 aa, Artificial Sequence
  Description of Artificial Sequence: Synthetic peptide
SCYHIL

SEQ ID NO: 1567 - protein, 6 aa, Artificial Sequence
  Description of Artificial Sequence: Synthetic peptide
SCYPYI

SEQ ID NO: 1568 - protein, 6 aa, Artificial Sequence
  Description of Artificial Sequence: Synthetic peptide
SCYRIL

SEQ ID NO: 1569 - protein, 6 aa, Artificial Sequence
  Description of Artificial Sequence: Synthetic peptide
SCYRTL

SEQ ID NO: 1570 - protein, 6 aa, Artificial Sequence
  Description of Artificial Sequence: Synthetic peptide
SDYCNL

SEQ ID NO: 1571 - protein, 6 aa, Artificial Sequence
  Description of Artificial Sequence: Synthetic peptide
SDYEDL

SEQ ID NO: 1572 - protein, 6 aa, Artificial Sequence
  Description of Artificial Sequence: Synthetic peptide
SDYENV

SEQ ID NO: 1573 - protein, 6 aa, Artificial Sequence
  Description of Artificial Sequence: Synthetic peptide
SDYESV

SEQ ID NO: 1574 - protein, 6 aa, Artificial Sequence
  Description of Artificial Sequence: Synthetic peptide
SDYFIV

SEQ ID NO: 1575 - protein, 6 aa, Artificial Sequence
  Description of Artificial Sequence: Synthetic peptide
SDYHTL

SEQ ID NO: 1576 - protein, 6 aa, Artificial Sequence
  Description of Artificial Sequence: Synthetic peptide
SDYLAI

SEQ ID NO: 1577 - protein, 6 aa, Artificial Sequence
  Description of Artificial Sequence: Synthetic peptide
SDYLDI

SEQ ID NO: 1578 - protein, 6 aa, Artificial Sequence
  Description of Artificial Sequence: Synthetic peptide
SDYLEL

SEQ ID NO: 1579 - protein, 6 aa, Artificial Sequence
  Description of Artificial Sequence: Synthetic peptide
SDYQDL

SEQ ID NO: 1580 - protein, 6 aa, Artificial Sequence
  Description of Artificial Sequence: Synthetic peptide
SDYQRL

SEQ ID NO: 1581 - protein, 6 aa, Artificial Sequence
  Description of Artificial Sequence: Synthetic peptide
SDYSVI

SEQ ID NO: 1582 - protein, 6 aa, Artificial Sequence
  Description of Artificial Sequence: Synthetic peptide
SDYTHL

SEQ ID NO: 1583 - protein, 6 aa, Artificial Sequence
  Description of Artificial Sequence: Synthetic peptide
SEYASV

SEQ ID NO: 1584 - protein, 6 aa, Artificial Sequence
  Description of Artificial Sequence: Synthetic peptide
SEYEEL

SEQ ID NO: 1585 - protein, 6 aa, Artificial Sequence
  Description of Artificial Sequence: Synthetic peptide
SEYFEL

SEQ ID NO: 1586 - protein, 6 aa, Artificial Sequence
  Description of Artificial Sequence: Synthetic peptide
SEYGEL

SEQ ID NO: 1587 - protein, 6 aa, Artificial Sequence
  Description of Artificial Sequence: Synthetic peptide
SEYITL

SEQ ID NO: 1588 - protein, 6 aa, Artificial Sequence
  Description of Artificial Sequence: Synthetic peptide
SEYKAL

SEQ ID NO: 1589 - protein, 6 aa, Artificial Sequence
  Description of Artificial Sequence: Synthetic peptide
SEYKEL

SEQ ID NO: 1590 - protein, 6 aa, Artificial Sequence
  Description of Artificial Sequence: Synthetic peptide
SEYKGI

SEQ ID NO: 1591 - protein, 6 aa, Artificial Sequence
  Description of Artificial Sequence: Synthetic peptide
SEYLAI

SEQ ID NO: 1592 - protein, 6 aa, Artificial Sequence
  Description of Artificial Sequence: Synthetic peptide
SEYLEI

SEQ ID NO: 1593 - protein, 6 aa, Artificial Sequence
  Description of Artificial Sequence: Synthetic peptide
SEYMVI

SEQ ID NO: 1594 - protein, 6 aa, Artificial Sequence
  Description of Artificial Sequence: Synthetic peptide
SEYQSI

SEQ ID NO: 1595 - protein, 6 aa, Artificial Sequence
  Description of Artificial Sequence: Synthetic peptide
SEYRPI

SEQ ID NO: 1596 - protein, 6 aa, Artificial Sequence
  Description of Artificial Sequence: Synthetic peptide
SEYSEI

SEQ ID NO: 1597 - protein, 6 aa, Artificial Sequence
  Description of Artificial Sequence: Synthetic peptide
SEYSSI

SEQ ID NO: 1598 - protein, 6 aa, Artificial Sequence
  Description of Artificial Sequence: Synthetic peptide
SEYTPI

SEQ ID NO: 1599 - protein, 6 aa, Artificial Sequence
  Description of Artificial Sequence: Synthetic peptide
SEYTYV

SEQ ID NO: 1600 - protein, 6 aa, Artificial Sequence
  Description of Artificial Sequence: Synthetic peptide
SFYAAL

SEQ ID NO: 1601 - protein, 6 aa, Artificial Sequence
  Description of Artificial Sequence: Synthetic peptide
SFYDSL

SEQ ID NO: 1602 - protein, 6 aa, Artificial Sequence
  Description of Artificial Sequence: Synthetic peptide
SFYKGL

SEQ ID NO: 1603 - protein, 6 aa, Artificial Sequence
  Description of Artificial Sequence: Synthetic peptide
SFYLYV

SEQ ID NO: 1604 - protein, 6 aa, Artificial Sequence
  Description of Artificial Sequence: Synthetic peptide
SFYNAV

SEQ ID NO: 1605 - protein, 6 aa, Artificial Sequence
  Description of Artificial Sequence: Synthetic peptide
SFYPSV

SEQ ID NO: 1606 - protein, 6 aa, Artificial Sequence
  Description of Artificial Sequence: Synthetic peptide
SFYQQI

SEQ ID NO: 1607 - protein, 6 aa, Artificial Sequence
  Description of Artificial Sequence: Synthetic peptide
SFYQQL

SEQ ID NO: 1608 - protein, 6 aa, Artificial Sequence
  Description of Artificial Sequence: Synthetic peptide
SFYSAL

SEQ ID NO: 1609 - protein, 6 aa, Artificial Sequence
  Description of Artificial Sequence: Synthetic peptide
SFYSDI

SEQ ID NO: 1610 - protein, 6 aa, Artificial Sequence
  Description of Artificial Sequence: Synthetic peptide
SFYSKL

SEQ ID NO: 1611 - protein, 6 aa, Artificial Sequence
  Description of Artificial Sequence: Synthetic peptide
SFYSRV

SEQ ID NO: 1612 - protein, 6 aa, Artificial Sequence
  Description of Artificial Sequence: Synthetic peptide
SFYWNV

SEQ ID NO: 1613 - protein, 6 aa, Artificial Sequence
  Description of Artificial Sequence: Synthetic peptide
SFYYLI

SEQ ID NO: 1614 - protein, 6 aa, Artificial Sequence
  Description of Artificial Sequence: Synthetic peptide
SGYAQL

SEQ ID NO: 1615 - protein, 6 aa, Artificial Sequence
  Description of Artificial Sequence: Synthetic peptide
SGYATL

SEQ ID NO: 1616 - protein, 6 aa, Artificial Sequence
  Description of Artificial Sequence: Synthetic peptide
SGYEKL

SEQ ID NO: 1617 - protein, 6 aa, Artificial Sequence
  Description of Artificial Sequence: Synthetic peptide
SGYQLV

SEQ ID NO: 1618 - protein, 6 aa, Artificial Sequence
  Description of Artificial Sequence: Synthetic peptide
SGYQRI

SEQ ID NO: 1619 - protein, 6 aa, Artificial Sequence
  Description of Artificial Sequence: Synthetic peptide
SGYRRL

SEQ ID NO: 1620 - protein, 6 aa, Artificial Sequence
  Description of Artificial Sequence: Synthetic peptide
SGYSHL

SEQ ID NO: 1621 - protein, 6 aa, Artificial Sequence
  Description of Artificial Sequence: Synthetic peptide
SGYSQL

SEQ ID NO: 1622 - protein, 6 aa, Artificial Sequence
  Description of Artificial Sequence: Synthetic peptide
SGYTLI

SEQ ID NO: 1623 - protein, 6 aa, Artificial Sequence
  Description of Artificial Sequence: Synthetic peptide
SGYTRI

SEQ ID NO: 1624 - protein, 6 aa, Artificial Sequence
  Description of Artificial Sequence: Synthetic peptide
SGYYRV

SEQ ID NO: 1625 - protein, 6 aa, Artificial Sequence
  Description of Artificial Sequence: Synthetic peptide
SHYADV

SEQ ID NO: 1626 - protein, 6 aa, Artificial Sequence
  Description of Artificial Sequence: Synthetic peptide
SHYFPL

SEQ ID NO: 1627 - protein, 6 aa, Artificial Sequence
  Description of Artificial Sequence: Synthetic peptide
SHYIDI

SEQ ID NO: 1628 - protein, 6 aa, Artificial Sequence
  Description of Artificial Sequence: Synthetic peptide
SHYKRL

SEQ ID NO: 1629 - protein, 6 aa, Artificial Sequence
  Description of Artificial Sequence: Synthetic peptide
SHYQVV

SEQ ID NO: 1630 - protein, 6 aa, Artificial Sequence
  Description of Artificial Sequence: Synthetic peptide
SIYAPL

SEQ ID NO: 1631 - protein, 6 aa, Artificial Sequence
  Description of Artificial Sequence: Synthetic peptide
SIYATL

SEQ ID NO: 1632 - protein, 6 aa, Artificial Sequence
  Description of Artificial Sequence: Synthetic peptide
SIYEEL

SEQ ID NO: 1633 - protein, 6 aa, Artificial Sequence
  Description of Artificial Sequence: Synthetic peptide
SIYEEV

SEQ ID NO: 1634 - protein, 6 aa, Artificial Sequence
  Description of Artificial Sequence: Synthetic peptide
SIYELL

SEQ ID NO: 1635 - protein, 6 aa, Artificial Sequence
  Description of Artificial Sequence: Synthetic peptide
SIYEVL

SEQ ID NO: 1636 - protein, 6 aa, Artificial Sequence
  Description of Artificial Sequence: Synthetic peptide
SIYGDL

SEQ ID NO: 1637 - protein, 6 aa, Artificial Sequence
  Description of Artificial Sequence: Synthetic peptide
SIYKKL

SEQ ID NO: 1638 - protein, 6 aa, Artificial Sequence
  Description of Artificial Sequence: Synthetic peptide
SIYLNI

SEQ ID NO: 1639 - protein, 6 aa, Artificial Sequence
  Description of Artificial Sequence: Synthetic peptide
SIYLVI

SEQ ID NO: 1640 - protein, 6 aa, Artificial Sequence
  Description of Artificial Sequence: Synthetic peptide
SIYRYI

SEQ ID NO: 1641 - protein, 6 aa, Artificial Sequence
  Description of Artificial Sequence: Synthetic peptide
SIYSWI

SEQ ID NO: 1642 - protein, 6 aa, Artificial Sequence
  Description of Artificial Sequence: Synthetic peptide
SKYKEI

SEQ ID NO: 1643 - protein, 6 aa, Artificial Sequence
  Description of Artificial Sequence: Synthetic peptide
SKYKIL

SEQ ID NO: 1644 - protein, 6 aa, Artificial Sequence
  Description of Artificial Sequence: Synthetic peptide
SKYKSL

SEQ ID NO: 1645 - protein, 6 aa, Artificial Sequence
  Description of Artificial Sequence: Synthetic peptide
SKYLAV

SEQ ID NO: 1646 - protein, 6 aa, Artificial Sequence
  Description of Artificial Sequence: Synthetic peptide
SKYLGV

SEQ ID NO: 1647 - protein, 6 aa, Artificial Sequence
  Description of Artificial Sequence: Synthetic peptide
SKYNIL

SEQ ID NO: 1648 - protein, 6 aa, Artificial Sequence
  Description of Artificial Sequence: Synthetic peptide
SKYQAV

SEQ ID NO: 1649 - protein, 6 aa, Artificial Sequence
  Description of Artificial Sequence: Synthetic peptide
SKYSDI

SEQ ID NO: 1650 - protein, 6 aa, Artificial Sequence
  Description of Artificial Sequence: Synthetic peptide
SKYSSL

SEQ ID NO: 1651 - protein, 6 aa, Artificial Sequence
  Description of Artificial Sequence: Synthetic peptide
SKYVGL

SEQ ID NO: 1652 - protein, 6 aa, Artificial Sequence
  Description of Artificial Sequence: Synthetic peptide
SKYVSL

SEQ ID NO: 1653 - protein, 6 aa, Artificial Sequence
  Description of Artificial Sequence: Synthetic peptide
SLYANI

SEQ ID NO: 1654 - protein, 6 aa, Artificial Sequence
  Description of Artificial Sequence: Synthetic peptide
SLYAQV

SEQ ID NO: 1655 - protein, 6 aa, Artificial Sequence
  Description of Artificial Sequence: Synthetic peptide
SLYAYI

SEQ ID NO: 1656 - protein, 6 aa, Artificial Sequence
  Description of Artificial Sequence: Synthetic peptide
SLYDDL

SEQ ID NO: 1657 - protein, 6 aa, Artificial Sequence
  Description of Artificial Sequence: Synthetic peptide
SLYDFL

SEQ ID NO: 1658 - protein, 6 aa, Artificial Sequence
  Description of Artificial Sequence: Synthetic peptide
SLYDNL

SEQ ID NO: 1659 - protein, 6 aa, Artificial Sequence
  Description of Artificial Sequence: Synthetic peptide
SLYDSI

SEQ ID NO: 1660 - protein, 6 aa, Artificial Sequence
  Description of Artificial Sequence: Synthetic peptide
SLYDYL

SEQ ID NO: 1661 - protein, 6 aa, Artificial Sequence
  Description of Artificial Sequence: Synthetic peptide
SLYEGL

SEQ ID NO: 1662 - protein, 6 aa, Artificial Sequence
  Description of Artificial Sequence: Synthetic peptide
SLYEHI

SEQ ID NO: 1663 - protein, 6 aa, Artificial Sequence
  Description of Artificial Sequence: Synthetic peptide
SLYELL

SEQ ID NO: 1664 - protein, 6 aa, Artificial Sequence
  Description of Artificial Sequence: Synthetic peptide
SLYHCL

SEQ ID NO: 1665 - protein, 6 aa, Artificial Sequence
  Description of Artificial Sequence: Synthetic peptide
SLYHKL

SEQ ID NO: 1666 - protein, 6 aa, Artificial Sequence
  Description of Artificial Sequence: Synthetic peptide
SLYIGI

SEQ ID NO: 1667 - protein, 6 aa, Artificial Sequence
  Description of Artificial Sequence: Synthetic peptide
SLYKKL

SEQ ID NO: 1668 - protein, 6 aa, Artificial Sequence
  Description of Artificial Sequence: Synthetic peptide
SLYKNL

SEQ ID NO: 1669 - protein, 6 aa, Artificial Sequence
  Description of Artificial Sequence: Synthetic peptide
SLYLAI

SEQ ID NO: 1670 - protein, 6 aa, Artificial Sequence
  Description of Artificial Sequence: Synthetic peptide
SLYLGI

SEQ ID NO: 1671 - protein, 6 aa, Artificial Sequence
  Description of Artificial Sequence: Synthetic peptide
SLYNAL

SEQ ID NO: 1672 - protein, 6 aa, Artificial Sequence
  Description of Artificial Sequence: Synthetic peptide
SLYNLL

SEQ ID NO: 1673 - protein, 6 aa, Artificial Sequence
  Description of Artificial Sequence: Synthetic peptide
SLYRNI

SEQ ID NO: 1674 - protein, 6 aa, Artificial Sequence
  Description of Artificial Sequence: Synthetic peptide
SLYSDV

SEQ ID NO: 1675 - protein, 6 aa, Artificial Sequence
  Description of Artificial Sequence: Synthetic peptide
SLYTCV

SEQ ID NO: 1676 - protein, 6 aa, Artificial Sequence
  Description of Artificial Sequence: Synthetic peptide
SLYTTL

SEQ ID NO: 1677 - protein, 6 aa, Artificial Sequence
  Description of Artificial Sequence: Synthetic peptide
SLYVAI

SEQ ID NO: 1678 - protein, 6 aa, Artificial Sequence
  Description of Artificial Sequence: Synthetic peptide
SLYVDV

SEQ ID NO: 1679 - protein, 6 aa, Artificial Sequence
  Description of Artificial Sequence: Synthetic peptide
SLYVSI

SEQ ID NO: 1680 - protein, 6 aa, Artificial Sequence
  Description of Artificial Sequence: Synthetic peptide
SLYYAL

SEQ ID NO: 1681 - protein, 6 aa, Artificial Sequence
  Description of Artificial Sequence: Synthetic peptide
SLYYNI

SEQ ID NO: 1682 - protein, 6 aa, Artificial Sequence
  Description of Artificial Sequence: Synthetic peptide
SLYYPI

SEQ ID NO: 1683 - protein, 6 aa, Artificial Sequence
  Description of Artificial Sequence: Synthetic peptide
SMYDGL

SEQ ID NO: 1684 - protein, 6 aa, Artificial Sequence
  Description of Artificial Sequence: Synthetic peptide
SMYEDI

SEQ ID NO: 1685 - protein, 6 aa, Artificial Sequence
  Description of Artificial Sequence: Synthetic peptide
SMYNEI

SEQ ID NO: 1686 - protein, 6 aa, Artificial Sequence
  Description of Artificial Sequence: Synthetic peptide
SMYQSV

SEQ ID NO: 1687 - protein, 6 aa, Artificial Sequence
  Description of Artificial Sequence: Synthetic peptide
SMYTWL

SEQ ID NO: 1688 - protein, 6 aa, Artificial Sequence
  Description of Artificial Sequence: Synthetic peptide
SMYVSI

SEQ ID NO: 1689 - protein, 6 aa, Artificial Sequence
  Description of Artificial Sequence: Synthetic peptide
SNYENL

SEQ ID NO: 1690 - protein, 6 aa, Artificial Sequence
  Description of Artificial Sequence: Synthetic peptide
SNYGSL

SEQ ID NO: 1691 - protein, 6 aa, Artificial Sequence
  Description of Artificial Sequence: Synthetic peptide
SNYGTI

SEQ ID NO: 1692 - protein, 6 aa, Artificial Sequence
  Description of Artificial Sequence: Synthetic peptide
SNYLVL

SEQ ID NO: 1693 - protein, 6 aa, Artificial Sequence
  Description of Artificial Sequence: Synthetic peptide
SNYQEI

SEQ ID NO: 1694 - protein, 6 aa, Artificial Sequence
  Description of Artificial Sequence: Synthetic peptide
SNYRLL

SEQ ID NO: 1695 - protein, 6 aa, Artificial Sequence
  Description of Artificial Sequence: Synthetic peptide
SNYRTL

SEQ ID NO: 1696 - protein, 6 aa, Artificial Sequence
  Description of Artificial Sequence: Synthetic peptide
SNYSDI

SEQ ID NO: 1697 - protein, 6 aa, Artificial Sequence
  Description of Artificial Sequence: Synthetic peptide
SNYSLL

SEQ ID NO: 1698 - protein, 6 aa, Artificial Sequence
  Description of Artificial Sequence: Synthetic peptide
SPYAEI

SEQ ID NO: 1699 - protein, 6 aa, Artificial Sequence
  Description of Artificial Sequence: Synthetic peptide
SPYATL

SEQ ID NO: 1700 - protein, 6 aa, Artificial Sequence
  Description of Artificial Sequence: Synthetic peptide
SPYEKV

SEQ ID NO: 1701 - protein, 6 aa, Artificial Sequence
  Description of Artificial Sequence: Synthetic peptide
SPYGDI

SEQ ID NO: 1702 - protein, 6 aa, Artificial Sequence
  Description of Artificial Sequence: Synthetic peptide
SPYGGL

SEQ ID NO: 1703 - protein, 6 aa, Artificial Sequence
  Description of Artificial Sequence: Synthetic peptide
SPYNTL

SEQ ID NO: 1704 - protein, 6 aa, Artificial Sequence
  Description of Artificial Sequence: Synthetic peptide
SPYPGI

SEQ ID NO: 1705 - protein, 6 aa, Artificial Sequence
  Description of Artificial Sequence: Synthetic peptide
SPYPGV

SEQ ID NO: 1706 - protein, 6 aa, Artificial Sequence
  Description of Artificial Sequence: Synthetic peptide
SPYQEL

SEQ ID NO: 1707 - protein, 6 aa, Artificial Sequence
  Description of Artificial Sequence: Synthetic peptide
SPYRSV

SEQ ID NO: 1708 - protein, 6 aa, Artificial Sequence
  Description of Artificial Sequence: Synthetic peptide
SPYSRL

SEQ ID NO: 1709 - protein, 6 aa, Artificial Sequence
  Description of Artificial Sequence: Synthetic peptide
SPYTDV

SEQ ID NO: 1710 - protein, 6 aa, Artificial Sequence
  Description of Artificial Sequence: Synthetic peptide
SPYTSV

SEQ ID NO: 1711 - protein, 6 aa, Artificial Sequence
  Description of Artificial Sequence: Synthetic peptide
SPYVVI

SEQ ID NO: 1712 - protein, 6 aa, Artificial Sequence
  Description of Artificial Sequence: Synthetic peptide
SQYCVL

SEQ ID NO: 1713 - protein, 6 aa, Artificial Sequence
  Description of Artificial Sequence: Synthetic peptide
SQYEAL

SEQ ID NO: 1714 - protein, 6 aa, Artificial Sequence
  Description of Artificial Sequence: Synthetic peptide
SQYKRL

SEQ ID NO: 1715 - protein, 6 aa, Artificial Sequence
  Description of Artificial Sequence: Synthetic peptide
SQYLAL

SEQ ID NO: 1716 - protein, 6 aa, Artificial Sequence
  Description of Artificial Sequence: Synthetic peptide
SQYLRL

SEQ ID NO: 1717 - protein, 6 aa, Artificial Sequence
  Description of Artificial Sequence: Synthetic peptide
SQYMHV

SEQ ID NO: 1718 - protein, 6 aa, Artificial Sequence
  Description of Artificial Sequence: Synthetic peptide
SQYSAV

SEQ ID NO: 1719 - protein, 6 aa, Artificial Sequence
  Description of Artificial Sequence: Synthetic peptide
SQYTSI

SEQ ID NO: 1720 - protein, 6 aa, Artificial Sequence
  Description of Artificial Sequence: Synthetic peptide
SQYWRL

SEQ ID NO: 1721 - protein, 6 aa, Artificial Sequence
  Description of Artificial Sequence: Synthetic peptide
SRYAEL

SEQ ID NO: 1722 - protein, 6 aa, Artificial Sequence
  Description of Artificial Sequence: Synthetic peptide
SRYATL

SEQ ID NO: 1723 - protein, 6 aa, Artificial Sequence
  Description of Artificial Sequence: Synthetic peptide
SRYESL

SEQ ID NO: 1724 - protein, 6 aa, Artificial Sequence
  Description of Artificial Sequence: Synthetic peptide
SRYGLL

SEQ ID NO: 1725 - protein, 6 aa, Artificial Sequence
  Description of Artificial Sequence: Synthetic peptide
SRYLSL

SEQ ID NO: 1726 - protein, 6 aa, Artificial Sequence
  Description of Artificial Sequence: Synthetic peptide
SRYMEL

SEQ ID NO: 1727 - protein, 6 aa, Artificial Sequence
  Description of Artificial Sequence: Synthetic peptide
SRYMRI

SEQ ID NO: 1728 - protein, 6 aa, Artificial Sequence
  Description of Artificial Sequence: Synthetic peptide
SRYPPV

SEQ ID NO: 1729 - protein, 6 aa, Artificial Sequence
  Description of Artificial Sequence: Synthetic peptide
SRYQAL

SEQ ID NO: 1730 - protein, 6 aa, Artificial Sequence
  Description of Artificial Sequence: Synthetic peptide
SRYQQL

SEQ ID NO: 1731 - protein, 6 aa, Artificial Sequence
  Description of Artificial Sequence: Synthetic peptide
SRYRFI

SEQ ID NO: 1732 - protein, 6 aa, Artificial Sequence
  Description of Artificial Sequence: Synthetic peptide
SRYRFV

SEQ ID NO: 1733 - protein, 6 aa, Artificial Sequence
  Description of Artificial Sequence: Synthetic peptide
SRYSAL

SEQ ID NO: 1734 - protein, 6 aa, Artificial Sequence
  Description of Artificial Sequence: Synthetic peptide
SRYSDL

SEQ ID NO: 1735 - protein, 6 aa, Artificial Sequence
  Description of Artificial Sequence: Synthetic peptide
SRYTGL

SEQ ID NO: 1736 - protein, 6 aa, Artificial Sequence
  Description of Artificial Sequence: Synthetic peptide
SRYVRL

SEQ ID NO: 1737 - protein, 6 aa, Artificial Sequence
  Description of Artificial Sequence: Synthetic peptide
SSYDEL

SEQ ID NO: 1738 - protein, 6 aa, Artificial Sequence
  Description of Artificial Sequence: Synthetic peptide
SSYEAL

SEQ ID NO: 1739 - protein, 6 aa, Artificial Sequence
  Description of Artificial Sequence: Synthetic peptide
SSYEIV

SEQ ID NO: 1740 - protein, 6 aa, Artificial Sequence
  Description of Artificial Sequence: Synthetic peptide
SSYEPL

SEQ ID NO: 1741 - protein, 6 aa, Artificial Sequence
  Description of Artificial Sequence: Synthetic peptide
SSYGRL

SEQ ID NO: 1742 - protein, 6 aa, Artificial Sequence
  Description of Artificial Sequence: Synthetic peptide
SSYGSI

SEQ ID NO: 1743 - protein, 6 aa, Artificial Sequence
  Description of Artificial Sequence: Synthetic peptide
SSYGSL

SEQ ID NO: 1744 - protein, 6 aa, Artificial Sequence
  Description of Artificial Sequence: Synthetic peptide
SSYHII

SEQ ID NO: 1745 - protein, 6 aa, Artificial Sequence
  Description of Artificial Sequence: Synthetic peptide
SSYHIL

SEQ ID NO: 1746 - protein, 6 aa, Artificial Sequence
  Description of Artificial Sequence: Synthetic peptide
SSYHKL

SEQ ID NO: 1747 - protein, 6 aa, Artificial Sequence
  Description of Artificial Sequence: Synthetic peptide
SSYHNI

SEQ ID NO: 1748 - protein, 6 aa, Artificial Sequence
  Description of Artificial Sequence: Synthetic peptide
SSYIKV

SEQ ID NO: 1749 - protein, 6 aa, Artificial Sequence
  Description of Artificial Sequence: Synthetic peptide
SSYNSV

SEQ ID NO: 1750 - protein, 6 aa, Artificial Sequence
  Description of Artificial Sequence: Synthetic peptide
SSYQEI

SEQ ID NO: 1751 - protein, 6 aa, Artificial Sequence
  Description of Artificial Sequence: Synthetic peptide
SSYRKV

SEQ ID NO: 1752 - protein, 6 aa, Artificial Sequence
  Description of Artificial Sequence: Synthetic peptide
SSYRRV

SEQ ID NO: 1753 - protein, 6 aa, Artificial Sequence
  Description of Artificial Sequence: Synthetic peptide
SSYSDI

SEQ ID NO: 1754 - protein, 6 aa, Artificial Sequence
  Description of Artificial Sequence: Synthetic peptide
SSYTPL

SEQ ID NO: 1755 - protein, 6 aa, Artificial Sequence
  Description of Artificial Sequence: Synthetic peptide
SSYTRL

SEQ ID NO: 1756 - protein, 6 aa, Artificial Sequence
  Description of Artificial Sequence: Synthetic peptide
SSYTSV

SEQ ID NO: 1757 - protein, 6 aa, Artificial Sequence
  Description of Artificial Sequence: Synthetic peptide
SSYTTI

SEQ ID NO: 1758 - protein, 6 aa, Artificial Sequence
  Description of Artificial Sequence: Synthetic peptide
SSYVKL

SEQ ID NO: 1759 - protein, 6 aa, Artificial Sequence
  Description of Artificial Sequence: Synthetic peptide
STYAEV

SEQ ID NO: 1760 - protein, 6 aa, Artificial Sequence
  Description of Artificial Sequence: Synthetic peptide
STYAGI

SEQ ID NO: 1761 - protein, 6 aa, Artificial Sequence
  Description of Artificial Sequence: Synthetic peptide
STYAHL

SEQ ID NO: 1762 - protein, 6 aa, Artificial Sequence
  Description of Artificial Sequence: Synthetic peptide
STYALV

SEQ ID NO: 1763 - protein, 6 aa, Artificial Sequence
  Description of Artificial Sequence: Synthetic peptide
STYAPI

SEQ ID NO: 1764 - protein, 6 aa, Artificial Sequence
  Description of Artificial Sequence: Synthetic peptide
STYDHV

SEQ ID NO: 1765 - protein, 6 aa, Artificial Sequence
  Description of Artificial Sequence: Synthetic peptide
STYDKV

SEQ ID NO: 1766 - protein, 6 aa, Artificial Sequence
  Description of Artificial Sequence: Synthetic peptide
STYDQV

SEQ ID NO: 1767 - protein, 6 aa, Artificial Sequence
  Description of Artificial Sequence: Synthetic peptide
STYDRI

SEQ ID NO: 1768 - protein, 6 aa, Artificial Sequence
  Description of Artificial Sequence: Synthetic peptide
STYEEL

SEQ ID NO: 1769 - protein, 6 aa, Artificial Sequence
  Description of Artificial Sequence: Synthetic peptide
STYEYL

SEQ ID NO: 1770 - protein, 6 aa, Artificial Sequence
  Description of Artificial Sequence: Synthetic peptide
STYILV

SEQ ID NO: 1771 - protein, 6 aa, Artificial Sequence
  Description of Artificial Sequence: Synthetic peptide
STYLPL

SEQ ID NO: 1772 - protein, 6 aa, Artificial Sequence
  Description of Artificial Sequence: Synthetic peptide
STYMAV

SEQ ID NO: 1773 - protein, 6 aa, Artificial Sequence
  Description of Artificial Sequence: Synthetic peptide
STYQTL

SEQ ID NO: 1774 - protein, 6 aa, Artificial Sequence
  Description of Artificial Sequence: Synthetic peptide
STYRKL

SEQ ID NO: 1775 - protein, 6 aa, Artificial Sequence
  Description of Artificial Sequence: Synthetic peptide
STYSQL

SEQ ID NO: 1776 - protein, 6 aa, Artificial Sequence
  Description of Artificial Sequence: Synthetic peptide
STYTSI

SEQ ID NO: 1777 - protein, 6 aa, Artificial Sequence
  Description of Artificial Sequence: Synthetic peptide
STYYQV

SEQ ID NO: 1778 - protein, 6 aa, Artificial Sequence
  Description of Artificial Sequence: Synthetic peptide
SVYATL

SEQ ID NO: 1779 - protein, 6 aa, Artificial Sequence
  Description of Artificial Sequence: Synthetic peptide
SVYCFL

SEQ ID NO: 1780 - protein, 6 aa, Artificial Sequence
  Description of Artificial Sequence: Synthetic peptide
SVYCNL

SEQ ID NO: 1781 - protein, 6 aa, Artificial Sequence
  Description of Artificial Sequence: Synthetic peptide
SVYDSV

SEQ ID NO: 1782 - protein, 6 aa, Artificial Sequence
  Description of Artificial Sequence: Synthetic peptide
SVYDTI

SEQ ID NO: 1783 - protein, 6 aa, Artificial Sequence
  Description of Artificial Sequence: Synthetic peptide
SVYEKV

SEQ ID NO: 1784 - protein, 6 aa, Artificial Sequence
  Description of Artificial Sequence: Synthetic peptide
SVYEML

SEQ ID NO: 1785 - protein, 6 aa, Artificial Sequence
  Description of Artificial Sequence: Synthetic peptide
SVYGSV

SEQ ID NO: 1786 - protein, 6 aa, Artificial Sequence
  Description of Artificial Sequence: Synthetic peptide
SVYPII

SEQ ID NO: 1787 - protein, 6 aa, Artificial Sequence
  Description of Artificial Sequence: Synthetic peptide
SVYQPI

SEQ ID NO: 1788 - protein, 6 aa, Artificial Sequence
  Description of Artificial Sequence: Synthetic peptide
SVYRKV

SEQ ID NO: 1789 - protein, 6 aa, Artificial Sequence
  Description of Artificial Sequence: Synthetic peptide
SVYSHL

SEQ ID NO: 1790 - protein, 6 aa, Artificial Sequence
  Description of Artificial Sequence: Synthetic peptide
SVYSRV

SEQ ID NO: 1791 - protein, 6 aa, Artificial Sequence
  Description of Artificial Sequence: Synthetic peptide
SVYTAL

SEQ ID NO: 1792 - protein, 6 aa, Artificial Sequence
  Description of Artificial Sequence: Synthetic peptide
SVYTEL

SEQ ID NO: 1793 - protein, 6 aa, Artificial Sequence
  Description of Artificial Sequence: Synthetic peptide
SVYWKV

SEQ ID NO: 1794 - protein, 6 aa, Artificial Sequence
  Description of Artificial Sequence: Synthetic peptide
SWYDSI

SEQ ID NO: 1795 - protein, 6 aa, Artificial Sequence
  Description of Artificial Sequence: Synthetic peptide
SWYFTV

SEQ ID NO: 1796 - protein, 6 aa, Artificial Sequence
  Description of Artificial Sequence: Synthetic peptide
SYYKAI

SEQ ID NO: 1797 - protein, 6 aa, Artificial Sequence
  Description of Artificial Sequence: Synthetic peptide
SYYLKL

SEQ ID NO: 1798 - protein, 6 aa, Artificial Sequence
  Description of Artificial Sequence: Synthetic peptide
SYYSFV

SEQ ID NO: 1799 - protein, 6 aa, Artificial Sequence
  Description of Artificial Sequence: Synthetic peptide
SYYVTI

SEQ ID NO: 1800 - protein, 6 aa, Artificial Sequence
  Description of Artificial Sequence: Synthetic peptide
VAYADL

SEQ ID NO: 1801 - protein, 6 aa, Artificial Sequence
  Description of Artificial Sequence: Synthetic peptide
VAYARI

SEQ ID NO: 1802 - protein, 6 aa, Artificial Sequence
  Description of Artificial Sequence: Synthetic peptide
VAYARV

SEQ ID NO: 1803 - protein, 6 aa, Artificial Sequence
  Description of Artificial Sequence: Synthetic peptide
VAYDQL

SEQ ID NO: 1804 - protein, 6 aa, Artificial Sequence
  Description of Artificial Sequence: Synthetic peptide
VAYGHV

SEQ ID NO: 1805 - protein, 6 aa, Artificial Sequence
  Description of Artificial Sequence: Synthetic peptide
VAYKQV

SEQ ID NO: 1806 - protein, 6 aa, Artificial Sequence
  Description of Artificial Sequence: Synthetic peptide
VAYKRL

SEQ ID NO: 1807 - protein, 6 aa, Artificial Sequence
  Description of Artificial Sequence: Synthetic peptide
VAYNLL

SEQ ID NO: 1808 - protein, 6 aa, Artificial Sequence
  Description of Artificial Sequence: Synthetic peptide
VAYQRV

SEQ ID NO: 1809 - protein, 6 aa, Artificial Sequence
  Description of Artificial Sequence: Synthetic peptide
VAYSGV

SEQ ID NO: 1810 - protein, 6 aa, Artificial Sequence
  Description of Artificial Sequence: Synthetic peptide
VAYSQV

SEQ ID NO: 1811 - protein, 6 aa, Artificial Sequence
  Description of Artificial Sequence: Synthetic peptide
VCYCIV

SEQ ID NO: 1812 - protein, 6 aa, Artificial Sequence
  Description of Artificial Sequence: Synthetic peptide
VCYGLV

SEQ ID NO: 1813 - protein, 6 aa, Artificial Sequence
  Description of Artificial Sequence: Synthetic peptide
VCYGRL

SEQ ID NO: 1814 - protein, 6 aa, Artificial Sequence
  Description of Artificial Sequence: Synthetic peptide
VCYIVV

SEQ ID NO: 1815 - protein, 6 aa, Artificial Sequence
  Description of Artificial Sequence: Synthetic peptide
VCYLLV

SEQ ID NO: 1816 - protein, 6 aa, Artificial Sequence
  Description of Artificial Sequence: Synthetic peptide
VDYDCI

SEQ ID NO: 1817 - protein, 6 aa, Artificial Sequence
  Description of Artificial Sequence: Synthetic peptide
VDYDFL

SEQ ID NO: 1818 - protein, 6 aa, Artificial Sequence
  Description of Artificial Sequence: Synthetic peptide
VDYFTI

SEQ ID NO: 1819 - protein, 6 aa, Artificial Sequence
  Description of Artificial Sequence: Synthetic peptide
VDYFVL

SEQ ID NO: 1820 - protein, 6 aa, Artificial Sequence
  Description of Artificial Sequence: Synthetic peptide
VDYGEL

SEQ ID NO: 1821 - protein, 6 aa, Artificial Sequence
  Description of Artificial Sequence: Synthetic peptide
VDYILV

SEQ ID NO: 1822 - protein, 6 aa, Artificial Sequence
  Description of Artificial Sequence: Synthetic peptide
VDYIQV

SEQ ID NO: 1823 - protein, 6 aa, Artificial Sequence
  Description of Artificial Sequence: Synthetic peptide
VDYKNI

SEQ ID NO: 1824 - protein, 6 aa, Artificial Sequence
  Description of Artificial Sequence: Synthetic peptide
VDYMSI

SEQ ID NO: 1825 - protein, 6 aa, Artificial Sequence
  Description of Artificial Sequence: Synthetic peptide
VDYNLV

SEQ ID NO: 1826 - protein, 6 aa, Artificial Sequence
  Description of Artificial Sequence: Synthetic peptide
VDYPDV

SEQ ID NO: 1827 - protein, 6 aa, Artificial Sequence
  Description of Artificial Sequence: Synthetic peptide
VDYSDL

SEQ ID NO: 1828 - protein, 6 aa, Artificial Sequence
  Description of Artificial Sequence: Synthetic peptide
VDYSSV

SEQ ID NO: 1829 - protein, 6 aa, Artificial Sequence
  Description of Artificial Sequence: Synthetic peptide
VDYTTL

SEQ ID NO: 1830 - protein, 6 aa, Artificial Sequence
  Description of Artificial Sequence: Synthetic peptide
VDYVDV

SEQ ID NO: 1831 - protein, 6 aa, Artificial Sequence
  Description of Artificial Sequence: Synthetic peptide
VDYVGV

SEQ ID NO: 1832 - protein, 6 aa, Artificial Sequence
  Description of Artificial Sequence: Synthetic peptide
VDYVIL

SEQ ID NO: 1833 - protein, 6 aa, Artificial Sequence
  Description of Artificial Sequence: Synthetic peptide
VDYVQV

SEQ ID NO: 1834 - protein, 6 aa, Artificial Sequence
  Description of Artificial Sequence: Synthetic peptide
VEYAPL

SEQ ID NO: 1835 - protein, 6 aa, Artificial Sequence
  Description of Artificial Sequence: Synthetic peptide
VEYDPL

SEQ ID NO: 1836 - protein, 6 aa, Artificial Sequence
  Description of Artificial Sequence: Synthetic peptide
VEYGTI

SEQ ID NO: 1837 - protein, 6 aa, Artificial Sequence
  Description of Artificial Sequence: Synthetic peptide
VEYHRL

SEQ ID NO: 1838 - protein, 6 aa, Artificial Sequence
  Description of Artificial Sequence: Synthetic peptide
VEYLEV

SEQ ID NO: 1839 - protein, 6 aa, Artificial Sequence
  Description of Artificial Sequence: Synthetic peptide
VEYQLL

SEQ ID NO: 1840 - protein, 6 aa, Artificial Sequence
  Description of Artificial Sequence: Synthetic peptide
VEYRPL

SEQ ID NO: 1841 - protein, 6 aa, Artificial Sequence
  Description of Artificial Sequence: Synthetic peptide
VEYSSI

SEQ ID NO: 1842 - protein, 6 aa, Artificial Sequence
  Description of Artificial Sequence: Synthetic peptide
VEYSTV

SEQ ID NO: 1843 - protein, 6 aa, Artificial Sequence
  Description of Artificial Sequence: Synthetic peptide
VFYAEI

SEQ ID NO: 1844 - protein, 6 aa, Artificial Sequence
  Description of Artificial Sequence: Synthetic peptide
VFYLAV

SEQ ID NO: 1845 - protein, 6 aa, Artificial Sequence
  Description of Artificial Sequence: Synthetic peptide
VFYRQV

SEQ ID NO: 1846 - protein, 6 aa, Artificial Sequence
  Description of Artificial Sequence: Synthetic peptide
VFYVGV

SEQ ID NO: 1847 - protein, 6 aa, Artificial Sequence
  Description of Artificial Sequence: Synthetic peptide
VFYYVI

SEQ ID NO: 1848 - protein, 6 aa, Artificial Sequence
  Description of Artificial Sequence: Synthetic peptide
VFYYVL

SEQ ID NO: 1849 - protein, 6 aa, Artificial Sequence
  Description of Artificial Sequence: Synthetic peptide
VGYETI

SEQ ID NO: 1850 - protein, 6 aa, Artificial Sequence
  Description of Artificial Sequence: Synthetic peptide
VHYALL

SEQ ID NO: 1851 - protein, 6 aa, Artificial Sequence
  Description of Artificial Sequence: Synthetic peptide
VHYARL

SEQ ID NO: 1852 - protein, 6 aa, Artificial Sequence
  Description of Artificial Sequence: Synthetic peptide
VHYETL

SEQ ID NO: 1853 - protein, 6 aa, Artificial Sequence
  Description of Artificial Sequence: Synthetic peptide
VHYGGV

SEQ ID NO: 1854 - protein, 6 aa, Artificial Sequence
  Description of Artificial Sequence: Synthetic peptide
VHYHSL

SEQ ID NO: 1855 - protein, 6 aa, Artificial Sequence
  Description of Artificial Sequence: Synthetic peptide
VHYIPV

SEQ ID NO: 1856 - protein, 6 aa, Artificial Sequence
  Description of Artificial Sequence: Synthetic peptide
VHYKEI

SEQ ID NO: 1857 - protein, 6 aa, Artificial Sequence
  Description of Artificial Sequence: Synthetic peptide
VHYLQV

SEQ ID NO: 1858 - protein, 6 aa, Artificial Sequence
  Description of Artificial Sequence: Synthetic peptide
VHYNSL

SEQ ID NO: 1859 - protein, 6 aa, Artificial Sequence
  Description of Artificial Sequence: Synthetic peptide
VHYQSV

SEQ ID NO: 1860 - protein, 6 aa, Artificial Sequence
  Description of Artificial Sequence: Synthetic peptide
VHYRSL

SEQ ID NO: 1861 - protein, 6 aa, Artificial Sequence
  Description of Artificial Sequence: Synthetic peptide
VIYAQL

SEQ ID NO: 1862 - protein, 6 aa, Artificial Sequence
  Description of Artificial Sequence: Synthetic peptide
VIYDRL

SEQ ID NO: 1863 - protein, 6 aa, Artificial Sequence
  Description of Artificial Sequence: Synthetic peptide
VIYENV

SEQ ID NO: 1864 - protein, 6 aa, Artificial Sequence
  Description of Artificial Sequence: Synthetic peptide
VIYEPL

SEQ ID NO: 1865 - protein, 6 aa, Artificial Sequence
  Description of Artificial Sequence: Synthetic peptide
VIYERL

SEQ ID NO: 1866 - protein, 6 aa, Artificial Sequence
  Description of Artificial Sequence: Synthetic peptide
VIYIDV

SEQ ID NO: 1867 - protein, 6 aa, Artificial Sequence
  Description of Artificial Sequence: Synthetic peptide
VIYKKI

SEQ ID NO: 1868 - protein, 6 aa, Artificial Sequence
  Description of Artificial Sequence: Synthetic peptide
VIYKRI

SEQ ID NO: 1869 - protein, 6 aa, Artificial Sequence
  Description of Artificial Sequence: Synthetic peptide
VIYPFL

SEQ ID NO: 1870 - protein, 6 aa, Artificial Sequence
  Description of Artificial Sequence: Synthetic peptide
VIYPNI

SEQ ID NO: 1871 - protein, 6 aa, Artificial Sequence
  Description of Artificial Sequence: Synthetic peptide
VIYSDL

SEQ ID NO: 1872 - protein, 6 aa, Artificial Sequence
  Description of Artificial Sequence: Synthetic peptide
VIYSML

SEQ ID NO: 1873 - protein, 6 aa, Artificial Sequence
  Description of Artificial Sequence: Synthetic peptide
VIYSSV

SEQ ID NO: 1874 - protein, 6 aa, Artificial Sequence
  Description of Artificial Sequence: Synthetic peptide
VIYSWI

SEQ ID NO: 1875 - protein, 6 aa, Artificial Sequence
  Description of Artificial Sequence: Synthetic peptide
VKYADI

SEQ ID NO: 1876 - protein, 6 aa, Artificial Sequence
  Description of Artificial Sequence: Synthetic peptide
VKYARL

SEQ ID NO: 1877 - protein, 6 aa, Artificial Sequence
  Description of Artificial Sequence: Synthetic peptide
VKYATL

SEQ ID NO: 1878 - protein, 6 aa, Artificial Sequence
  Description of Artificial Sequence: Synthetic peptide
VKYEGL

SEQ ID NO: 1879 - protein, 6 aa, Artificial Sequence
  Description of Artificial Sequence: Synthetic peptide
VKYGDL

SEQ ID NO: 1880 - protein, 6 aa, Artificial Sequence
  Description of Artificial Sequence: Synthetic peptide
VKYGSV

SEQ ID NO: 1881 - protein, 6 aa, Artificial Sequence
  Description of Artificial Sequence: Synthetic peptide
VKYLLV

SEQ ID NO: 1882 - protein, 6 aa, Artificial Sequence
  Description of Artificial Sequence: Synthetic peptide
VKYNPV

SEQ ID NO: 1883 - protein, 6 aa, Artificial Sequence
  Description of Artificial Sequence: Synthetic peptide
VKYPPI

SEQ ID NO: 1884 - protein, 6 aa, Artificial Sequence
  Description of Artificial Sequence: Synthetic peptide
VKYQRL

SEQ ID NO: 1885 - protein, 6 aa, Artificial Sequence
  Description of Artificial Sequence: Synthetic peptide
VKYQVI

SEQ ID NO: 1886 - protein, 6 aa, Artificial Sequence
  Description of Artificial Sequence: Synthetic peptide
VKYSEV

SEQ ID NO: 1887 - protein, 6 aa, Artificial Sequence
  Description of Artificial Sequence: Synthetic peptide
VKYSNV

SEQ ID NO: 1888 - protein, 6 aa, Artificial Sequence
  Description of Artificial Sequence: Synthetic peptide
VKYSRL

SEQ ID NO: 1889 - protein, 6 aa, Artificial Sequence
  Description of Artificial Sequence: Synthetic peptide
VKYSTL

SEQ ID NO: 1890 - protein, 6 aa, Artificial Sequence
  Description of Artificial Sequence: Synthetic peptide
VKYVDL

SEQ ID NO: 1891 - protein, 6 aa, Artificial Sequence
  Description of Artificial Sequence: Synthetic peptide
VLYADI

SEQ ID NO: 1892 - protein, 6 aa, Artificial Sequence
  Description of Artificial Sequence: Synthetic peptide
VLYAML

SEQ ID NO: 1893 - protein, 6 aa, Artificial Sequence
  Description of Artificial Sequence: Synthetic peptide
VLYASV

SEQ ID NO: 1894 - protein, 6 aa, Artificial Sequence
  Description of Artificial Sequence: Synthetic peptide
VLYCLL

SEQ ID NO: 1895 - protein, 6 aa, Artificial Sequence
  Description of Artificial Sequence: Synthetic peptide
VLYCLV

SEQ ID NO: 1896 - protein, 6 aa, Artificial Sequence
  Description of Artificial Sequence: Synthetic peptide
VLYCVL

SEQ ID NO: 1897 - protein, 6 aa, Artificial Sequence
  Description of Artificial Sequence: Synthetic peptide
VLYDCL

SEQ ID NO: 1898 - protein, 6 aa, Artificial Sequence
  Description of Artificial Sequence: Synthetic peptide
VLYFHI

SEQ ID NO: 1899 - protein, 6 aa, Artificial Sequence
  Description of Artificial Sequence: Synthetic peptide
VLYFTV

SEQ ID NO: 1900 - protein, 6 aa, Artificial Sequence
  Description of Artificial Sequence: Synthetic peptide
VLYGDL

SEQ ID NO: 1901 - protein, 6 aa, Artificial Sequence
  Description of Artificial Sequence: Synthetic peptide
VLYGQL

SEQ ID NO: 1902 - protein, 6 aa, Artificial Sequence
  Description of Artificial Sequence: Synthetic peptide
VLYPMV

SEQ ID NO: 1903 - protein, 6 aa, Artificial Sequence
  Description of Artificial Sequence: Synthetic peptide
VLYPRL

SEQ ID NO: 1904 - protein, 6 aa, Artificial Sequence
  Description of Artificial Sequence: Synthetic peptide
VLYPRV

SEQ ID NO: 1905 - protein, 6 aa, Artificial Sequence
  Description of Artificial Sequence: Synthetic peptide
VLYSEL

SEQ ID NO: 1906 - protein, 6 aa, Artificial Sequence
  Description of Artificial Sequence: Synthetic peptide
VLYSRV

SEQ ID NO: 1907 - protein, 6 aa, Artificial Sequence
  Description of Artificial Sequence: Synthetic peptide
VLYTAV

SEQ ID NO: 1908 - protein, 6 aa, Artificial Sequence
  Description of Artificial Sequence: Synthetic peptide
VLYTIL

SEQ ID NO: 1909 - protein, 6 aa, Artificial Sequence
  Description of Artificial Sequence: Synthetic peptide
VMYDAV

SEQ ID NO: 1910 - protein, 6 aa, Artificial Sequence
  Description of Artificial Sequence: Synthetic peptide
VNYESI

SEQ ID NO: 1911 - protein, 6 aa, Artificial Sequence
  Description of Artificial Sequence: Synthetic peptide
VNYSAL

SEQ ID NO: 1912 - protein, 6 aa, Artificial Sequence
  Description of Artificial Sequence: Synthetic peptide
VNYSKI

SEQ ID NO: 1913 - protein, 6 aa, Artificial Sequence
  Description of Artificial Sequence: Synthetic peptide
VNYSSI

SEQ ID NO: 1914 - protein, 6 aa, Artificial Sequence
  Description of Artificial Sequence: Synthetic peptide
VPYALL

SEQ ID NO: 1915 - protein, 6 aa, Artificial Sequence
  Description of Artificial Sequence: Synthetic peptide
VPYDTL

SEQ ID NO: 1916 - protein, 6 aa, Artificial Sequence
  Description of Artificial Sequence: Synthetic peptide
VPYEDV

SEQ ID NO: 1917 - protein, 6 aa, Artificial Sequence
  Description of Artificial Sequence: Synthetic peptide
VPYEEL

SEQ ID NO: 1918 - protein, 6 aa, Artificial Sequence
  Description of Artificial Sequence: Synthetic peptide
VPYKTI

SEQ ID NO: 1919 - protein, 6 aa, Artificial Sequence
  Description of Artificial Sequence: Synthetic peptide
VPYLRV

SEQ ID NO: 1920 - protein, 6 aa, Artificial Sequence
  Description of Artificial Sequence: Synthetic peptide
VPYNDL

SEQ ID NO: 1921 - protein, 6 aa, Artificial Sequence
  Description of Artificial Sequence: Synthetic peptide
VPYPAL

SEQ ID NO: 1922 - protein, 6 aa, Artificial Sequence
  Description of Artificial Sequence: Synthetic peptide
VPYQEL

SEQ ID NO: 1923 - protein, 6 aa, Artificial Sequence
  Description of Artificial Sequence: Synthetic peptide
VPYRLL

SEQ ID NO: 1924 - protein, 6 aa, Artificial Sequence
  Description of Artificial Sequence: Synthetic peptide
VPYSEL

SEQ ID NO: 1925 - protein, 6 aa, Artificial Sequence
  Description of Artificial Sequence: Synthetic peptide
VPYTLL

SEQ ID NO: 1926 - protein, 6 aa, Artificial Sequence
  Description of Artificial Sequence: Synthetic peptide
VPYTPL

SEQ ID NO: 1927 - protein, 6 aa, Artificial Sequence
  Description of Artificial Sequence: Synthetic peptide
VPYTTL

SEQ ID NO: 1928 - protein, 6 aa, Artificial Sequence
  Description of Artificial Sequence: Synthetic peptide
VPYVEL

SEQ ID NO: 1929 - protein, 6 aa, Artificial Sequence
  Description of Artificial Sequence: Synthetic peptide
VPYVMV

SEQ ID NO: 1930 - protein, 6 aa, Artificial Sequence
  Description of Artificial Sequence: Synthetic peptide
VPYVSL

SEQ ID NO: 1931 - protein, 6 aa, Artificial Sequence
  Description of Artificial Sequence: Synthetic peptide
VQYKAV

SEQ ID NO: 1932 - protein, 6 aa, Artificial Sequence
  Description of Artificial Sequence: Synthetic peptide
VQYKEI

SEQ ID NO: 1933 - protein, 6 aa, Artificial Sequence
  Description of Artificial Sequence: Synthetic peptide
VQYNIV

SEQ ID NO: 1934 - protein, 6 aa, Artificial Sequence
  Description of Artificial Sequence: Synthetic peptide
VQYRPV

SEQ ID NO: 1935 - protein, 6 aa, Artificial Sequence
  Description of Artificial Sequence: Synthetic peptide
VQYSQI

SEQ ID NO: 1936 - protein, 6 aa, Artificial Sequence
  Description of Artificial Sequence: Synthetic peptide
VQYSTV

SEQ ID NO: 1937 - protein, 6 aa, Artificial Sequence
  Description of Artificial Sequence: Synthetic peptide
VQYTEV

SEQ ID NO: 1938 - protein, 6 aa, Artificial Sequence
  Description of Artificial Sequence: Synthetic peptide
VQYYNI

SEQ ID NO: 1939 - protein, 6 aa, Artificial Sequence
  Description of Artificial Sequence: Synthetic peptide
VRYARL

SEQ ID NO: 1940 - protein, 6 aa, Artificial Sequence
  Description of Artificial Sequence: Synthetic peptide
VRYDNL

SEQ ID NO: 1941 - protein, 6 aa, Artificial Sequence
  Description of Artificial Sequence: Synthetic peptide
VRYGRI

SEQ ID NO: 1942 - protein, 6 aa, Artificial Sequence
  Description of Artificial Sequence: Synthetic peptide
VRYKKL

SEQ ID NO: 1943 - protein, 6 aa, Artificial Sequence
  Description of Artificial Sequence: Synthetic peptide
VRYKRV

SEQ ID NO: 1944 - protein, 6 aa, Artificial Sequence
  Description of Artificial Sequence: Synthetic peptide
VRYLDV

SEQ ID NO: 1945 - protein, 6 aa, Artificial Sequence
  Description of Artificial Sequence: Synthetic peptide
VRYRTI

SEQ ID NO: 1946 - protein, 6 aa, Artificial Sequence
  Description of Artificial Sequence: Synthetic peptide
VRYSDI

SEQ ID NO: 1947 - protein, 6 aa, Artificial Sequence
  Description of Artificial Sequence: Synthetic peptide
VRYTQL

SEQ ID NO: 1948 - protein, 6 aa, Artificial Sequence
  Description of Artificial Sequence: Synthetic peptide
VRYVCL

SEQ ID NO: 1949 - protein, 6 aa, Artificial Sequence
  Description of Artificial Sequence: Synthetic peptide
VSYAEL

SEQ ID NO: 1950 - protein, 6 aa, Artificial Sequence
  Description of Artificial Sequence: Synthetic peptide
VSYASV

SEQ ID NO: 1951 - protein, 6 aa, Artificial Sequence
  Description of Artificial Sequence: Synthetic peptide
VSYEPI

SEQ ID NO: 1952 - protein, 6 aa, Artificial Sequence
  Description of Artificial Sequence: Synthetic peptide
VSYGDI

SEQ ID NO: 1953 - protein, 6 aa, Artificial Sequence
  Description of Artificial Sequence: Synthetic peptide
VSYIGL

SEQ ID NO: 1954 - protein, 6 aa, Artificial Sequence
  Description of Artificial Sequence: Synthetic peptide
VSYILV

SEQ ID NO: 1955 - protein, 6 aa, Artificial Sequence
  Description of Artificial Sequence: Synthetic peptide
VSYMML

SEQ ID NO: 1956 - protein, 6 aa, Artificial Sequence
  Description of Artificial Sequence: Synthetic peptide
VSYNNI

SEQ ID NO: 1957 - protein, 6 aa, Artificial Sequence
  Description of Artificial Sequence: Synthetic peptide
VSYNNL

SEQ ID NO: 1958 - protein, 6 aa, Artificial Sequence
  Description of Artificial Sequence: Synthetic peptide
VSYQEI

SEQ ID NO: 1959 - protein, 6 aa, Artificial Sequence
  Description of Artificial Sequence: Synthetic peptide
VSYQPI

SEQ ID NO: 1960 - protein, 6 aa, Artificial Sequence
  Description of Artificial Sequence: Synthetic peptide
VSYSAV

SEQ ID NO: 1961 - protein, 6 aa, Artificial Sequence
  Description of Artificial Sequence: Synthetic peptide
VSYSFL

SEQ ID NO: 1962 - protein, 6 aa, Artificial Sequence
  Description of Artificial Sequence: Synthetic peptide
VSYSLV

SEQ ID NO: 1963 - protein, 6 aa, Artificial Sequence
  Description of Artificial Sequence: Synthetic peptide
VSYSPV

SEQ ID NO: 1964 - protein, 6 aa, Artificial Sequence
  Description of Artificial Sequence: Synthetic peptide
VSYTML

SEQ ID NO: 1965 - protein, 6 aa, Artificial Sequence
  Description of Artificial Sequence: Synthetic peptide
VSYTNL

SEQ ID NO: 1966 - protein, 6 aa, Artificial Sequence
  Description of Artificial Sequence: Synthetic peptide
VSYTPL

SEQ ID NO: 1967 - protein, 6 aa, Artificial Sequence
  Description of Artificial Sequence: Synthetic peptide
VSYVKI

SEQ ID NO: 1968 - protein, 6 aa, Artificial Sequence
  Description of Artificial Sequence: Synthetic peptide
VSYVLL

SEQ ID NO: 1969 - protein, 6 aa, Artificial Sequence
  Description of Artificial Sequence: Synthetic peptide
VTYADL

SEQ ID NO: 1970 - protein, 6 aa, Artificial Sequence
  Description of Artificial Sequence: Synthetic peptide
VTYAEL

SEQ ID NO: 1971 - protein, 6 aa, Artificial Sequence
  Description of Artificial Sequence: Synthetic peptide
VTYAEV

SEQ ID NO: 1972 - protein, 6 aa, Artificial Sequence
  Description of Artificial Sequence: Synthetic peptide
VTYAKV

SEQ ID NO: 1973 - protein, 6 aa, Artificial Sequence
  Description of Artificial Sequence: Synthetic peptide
VTYAPV

SEQ ID NO: 1974 - protein, 6 aa, Artificial Sequence
  Description of Artificial Sequence: Synthetic peptide
VTYAQL

SEQ ID NO: 1975 - protein, 6 aa, Artificial Sequence
  Description of Artificial Sequence: Synthetic peptide
VTYATL

SEQ ID NO: 1976 - protein, 6 aa, Artificial Sequence
  Description of Artificial Sequence: Synthetic peptide
VTYATV

SEQ ID NO: 1977 - protein, 6 aa, Artificial Sequence
  Description of Artificial Sequence: Synthetic peptide
VTYGNI

SEQ ID NO: 1978 - protein, 6 aa, Artificial Sequence
  Description of Artificial Sequence: Synthetic peptide
VTYITI

SEQ ID NO: 1979 - protein, 6 aa, Artificial Sequence
  Description of Artificial Sequence: Synthetic peptide
VTYQII

SEQ ID NO: 1980 - protein, 6 aa, Artificial Sequence
  Description of Artificial Sequence: Synthetic peptide
VTYQIL

SEQ ID NO: 1981 - protein, 6 aa, Artificial Sequence
  Description of Artificial Sequence: Synthetic peptide
VTYQLL

SEQ ID NO: 1982 - protein, 6 aa, Artificial Sequence
  Description of Artificial Sequence: Synthetic peptide
VTYSAL

SEQ ID NO: 1983 - protein, 6 aa, Artificial Sequence
  Description of Artificial Sequence: Synthetic peptide
VTYSTL

SEQ ID NO: 1984 - protein, 6 aa, Artificial Sequence
  Description of Artificial Sequence: Synthetic peptide
VTYTLL

SEQ ID NO: 1985 - protein, 6 aa, Artificial Sequence
  Description of Artificial Sequence: Synthetic peptide
VTYTQL

SEQ ID NO: 1986 - protein, 6 aa, Artificial Sequence
  Description of Artificial Sequence: Synthetic peptide
VTYVNL

SEQ ID NO: 1987 - protein, 6 aa, Artificial Sequence
  Description of Artificial Sequence: Synthetic peptide
VVYADI

SEQ ID NO: 1988 - protein, 6 aa, Artificial Sequence
  Description of Artificial Sequence: Synthetic peptide
VVYEDV

SEQ ID NO: 1989 - protein, 6 aa, Artificial Sequence
  Description of Artificial Sequence: Synthetic peptide
VVYFCL

SEQ ID NO: 1990 - protein, 6 aa, Artificial Sequence
  Description of Artificial Sequence: Synthetic peptide
VVYKTL

SEQ ID NO: 1991 - protein, 6 aa, Artificial Sequence
  Description of Artificial Sequence: Synthetic peptide
VVYQKL

SEQ ID NO: 1992 - protein, 6 aa, Artificial Sequence
  Description of Artificial Sequence: Synthetic peptide
VVYSEV

SEQ ID NO: 1993 - protein, 6 aa, Artificial Sequence
  Description of Artificial Sequence: Synthetic peptide
VVYSQV

SEQ ID NO: 1994 - protein, 6 aa, Artificial Sequence
  Description of Artificial Sequence: Synthetic peptide
VVYSVV

SEQ ID NO: 1995 - protein, 6 aa, Artificial Sequence
  Description of Artificial Sequence: Synthetic peptide
VVYTVL

SEQ ID NO: 1996 - protein, 6 aa, Artificial Sequence
  Description of Artificial Sequence: Synthetic peptide
VVYYRI

SEQ ID NO: 1997 - protein, 6 aa, Artificial Sequence
  Description of Artificial Sequence: Synthetic peptide
VYYHWL

SEQ ID NO: 1998 - protein, 6 aa, Artificial Sequence
  Description of Artificial Sequence: Synthetic peptide
VYYLPL

SEQ ID NO: 1999 - protein, 307 aa, Artificial Sequence
  Description of Artificial Sequence: Synthetic polypeptide
MMALPVTALLLPLALLLHAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAATERRAEVPTAHPSPSPRPAGQFQTLVVGVVGGLLGSLVLLVWVLAVI

SEQ ID NO: 2000 - protein, 97 aa, Artificial Sequence
  Description of Artificial Sequence: Synthetic polypeptide
CSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 2001 - protein, 111 aa, Artificial Sequence
  Description of Artificial Sequence: Synthetic polypeptide
RRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 2002 - protein, 120 aa, Artificial Sequence
  Description of Artificial Sequence: Synthetic polypeptide
WRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 2003 - protein, 138 aa, Artificial Sequence
  Description of Artificial Sequence: Synthetic polypeptide
CSRAARGTIGARRTGQPLKEDPSAVPVFSVDYGELDFQWREKTPEPPVPCVPEQTEYATIVFPSGMGTSSPARRGSADGPRSAQPLRPEDGHCSWPLAVSLSKMLKKRSPLTTGVYVKMPPTEPECEKQFQPYFIPIN

SEQ ID NO: 2004 - protein, 151 aa, Artificial Sequence
  Description of Artificial Sequence: Synthetic polypeptide
CSRAARGTIGARRTGQPLKEDPSAVPVFSVDYGELDFQWREKTPEPPVPCVPEQTEYATIVFPSGMGTSSPARRGSADGPRSAQPLRPEDGHCSWPLHLWRRQWRPRRFSALEQGIHPPQAQSKIEELEQEPEPEPEPEPEPEPEPEPEQL

SEQ ID NO: 2005 - protein, 194 aa, Artificial Sequence
  Description of Artificial Sequence: Synthetic polypeptide
CSRAARGTIGARRTGQPLKEDPSAVPVFSVDYGELDFQWREKTPEPPVPCVPEQTEYATIVFPSGMGTSSPARRGSADGPRSAQPLRPEDGHCSWPLCSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 2006 - protein, 175 aa, Artificial Sequence
  Description of Artificial Sequence: Synthetic polypeptide
CSRAARGTIGARRTGQPLKEDPSAVPVFSVDYGELDFQWREKTPEPPVPCVPEQTEYATIVFPSGMGTSSPARRGSADGPRSAQPLRPEDGHCSWPLFKWYSHSKEKIQNLSLISLANLPPSGLANAVAEGIRSEENIYTIEENVYEVEEPNEYYCYVSSRQQPSQPLGCRFAMP

SEQ ID NO: 2007 - protein, 113 aa, Artificial Sequence
  Description of Artificial Sequence: Synthetic polypeptide
WRMMKYQQKAAGMSPEQVLQPLEGDLCYADLTLQLAGTSPQKATTKLSSAQVDQVEVEYVTMASLPKEDISYASLTLGAEDQEPTYCNMGHLSSHLPGRGPEEPTEYSTISRP

SEQ ID NO: 2008 - protein, 179 aa, Artificial Sequence
  Description of Artificial Sequence: Synthetic polypeptide
KRKGRCSVPAFCSSQAEAPADTPEPTAGHTLYSVLSQGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQGKTPVSQKEESSATIYCSIRKPQVVPPPQQNDLEIPESPTYENFT

SEQ ID NO: 2009 - protein, 118 aa, Artificial Sequence
  Description of Artificial Sequence: Synthetic polypeptide
KCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPDAVESRYSRTEGSLDGT

SEQ ID NO: 2010 - protein, 94 aa, Artificial Sequence
  Description of Artificial Sequence: Synthetic polypeptide
VRSCRKKSARPAAGVGDTGIEDANAVRGSASQGPLTEPWAEDSPPDQPPPASARSSVGEGELQYASLSFQMVKPWDSRGQEATDTEYSEIKIHR

SEQ ID NO: 2011 - protein, 110 aa, Artificial Sequence
  Description of Artificial Sequence: Synthetic polypeptide
RIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 2012 - protein, 122 aa, Artificial Sequence
  Description of Artificial Sequence: Synthetic polypeptide
CSRAARGTIGARRTGQPLKEDPSAVPVFSVDYGELDFQWREKTPEPPVPCVPEQTEYATIDFQWREKTPEPPVPCVPEQTEYATIVFPSGMGTSSPARRGSADGPRSAQPLRPEDGHCSWPL

SEQ ID NO: 2013 - protein, 147 aa, Artificial Sequence
  Description of Artificial Sequence: Synthetic polypeptide
CSRAARGTIGARRTGQPLKEDPSAVPVFSVDYGELDFQWREKTPEPPVPCVPEQTEYATIDFQWREKTPEPPVPCVPEQTEYATIDFQWREKTPEPPVPCVPEQTEYATIVFPSGMGTSSPARRGSADGPRSAQPLRPEDGHCSWPL

SEQ ID NO: 2014 - protein, 97 aa, Artificial Sequence
  Description of Artificial Sequence: Synthetic polypeptide
CSRAARGTIGARRTGQPLKEDPSAVPVFSVDYGELDFQWREKTPEPPVPCVPEQTEYSEIVFPSGMGTSSPARRGSADGPRSAQPLRPEDGHCSWPL

SEQ ID NO: 2015 - protein, 97 aa, Artificial Sequence
  Description of Artificial Sequence: Synthetic polypeptide
CSRAARGTIGARRTGQPLKEDPSAVPVFSVDYGELDFQWREKTPEPPVPCVPEQTEYSEVVFPSGMGTSSPARRGSADGPRSAQPLRPEDGHCSWPL

SEQ ID NO: 2016 - protein, 97 aa, Artificial Sequence
  Description of Artificial Sequence: Synthetic polypeptide
CSRAARGTIGARRTGQPLKEDPSAVPVFSVDYGELDFQWREKTPEPPVPCVPEQTEYASIVFPSGMGTSSPARRGSADGPRSAQPLRPEDGHCSWPL

SEQ ID NO: 2017 - protein, 181 aa, Artificial Sequence
  Description of Artificial Sequence: Synthetic polypeptide
CSRAARGTIGARRTGQPLKEDPSAVPVFSVDYGELDFQWREKTPEPPVPCVPEQTEYATIVFPSGMGTSSPARRGSADGPRSAQPLRPEDGHCSWPLHRWCSNKKNAAVMDQESAGNRTANSEDSDEQDPQEVTYTQLNHCVFTQRKITRPSQRPKTPPTDIIVYAELPNAESRSKVVSCP

SEQ ID NO: 2018 - protein, 198 aa, Artificial Sequence
  Description of Artificial Sequence: Synthetic polypeptide
CSRAARGTIGARRTGQPLKEDPSAVPVFSVDYGELDFQWREKTPEPPVPCVPEQTEYATIVFPSGMGTSSPARRGSADGPRSAQPLRPEDGHCSWPLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 2019 - protein, 486 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2020 - protein, 485 aa, Artificial Sequence
  Description of Artificial Sequence: Synthetic polypeptide
MALPVTALLLPLALLLHAEVKLQQSGAELVRPGSSVKISCKASGYAFSSYWMNWVKQRPGQGLEWIGQIYPGDGDTNYNGKFKGQATLTADKSSSTAYMQLSGLTSEDSAVYFCARKTISSVVDFYFDYWGQGTTVTVSSGGGGSGGGGSGGGGSDIELTQSPKFMSTSVGDRVSVTCKASQNVGTNVAWYQQKPGQSPKPLIYSATYRNSGVPDRFTGSGSGTDFTLTITNVQSKDLADYFCQQYNRYPYTSGGGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2021 - protein, 168 aa, Artificial Sequence
  Description of Artificial Sequence: Synthetic polypeptide
LRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 2022 - protein, 82 aa, Artificial Sequence
  Description of Artificial Sequence: Synthetic polypeptide
LTRKKKALRIHSVEGDLRRKSAGQEEWSPSAPSPPGSCVQAEAAPAGLCGEQRGEDCAELHDYFNVLSYRSLGNCSFFTETG

SEQ ID NO: 2023 - protein, 74 aa, Artificial Sequence
  Description of Artificial Sequence: Synthetic polypeptide
HFGKTGRASDQRDLTEHKPSVSNHTQDHSNDPPNKMNEVTYSTLNFEAQQPTQPTSASPSLTATEIIYSEVKKQ

SEQ ID NO: 2024 - protein, 434 aa, Artificial Sequence
  Description of Artificial Sequence: Synthetic polypeptide
KYKQKPKYQVRWKIIESYEGNSYTFIDPTQLPYNEKWEFPRNNLQFGKTLGAGAFGKVVEATAFGLGKEDAVLKVAVKMLKSTAHADEKEALMSELKIMSHLGQHENIVNLLGACTHGGPVLVITEYCCYGDLLNFLRRKAEAMLGPSLSPGQDPEGGVDYKNIHLEKKYVRRDSGFSSQGVDTYVEMRPVSTSSNDSFSEQDLDKEDGRPLELRDLLHFSSQVAQGMAFLASKNCIHRDVAARNVLLTNGHVAKIGDFGLARDIMNDSNYIVKGNARLPVKWMAPESIFDCVYTVQSDVWSYGILLWEIFSLGLNPYPGILVNSKFYKLVKDGYQMAQPAFAPKNIYSIMQACWALEPTHRPTFQQICSFLQEQAQEDRRERDYTNLPSSSRSGGSGSSSSELEEESSSEHLTCCEQGDIAQPLLQPNNYQFC

SEQ ID NO: 2025 - protein, 93 aa, Artificial Sequence
  Description of Artificial Sequence: Synthetic polypeptide
KKLVKKFRQKKQRQWIGPTGMNQNMSFHRNHTATVRSHAENPTASHVDNEYSQPPRNSHLSAYPALEGALHRSSMQPDNSSDSDYDLHGAQRL

SEQ ID NO: 2026 - protein, 45 aa, Artificial Sequence
  Description of Artificial Sequence: Synthetic polypeptide
RKWCQYQKEIMERPPPFKPPPPPIKYTCIQEPNESDLPYHEMETL

SEQ ID NO: 2027 - protein, 141 aa, Artificial Sequence
  Description of Artificial Sequence: Synthetic polypeptide
KLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 2028 - protein, 26 aa, Artificial Sequence
  Description of Artificial Sequence: Synthetic peptide
RKPQVVPPPQQNDLEIPESPTYENFT

SEQ ID NO: 2029 - protein, 25 aa, Artificial Sequence
  Description of Artificial Sequence: Synthetic peptide
GKSQPKAQNPARLSRKELENFDVYS

SEQ ID NO: 2030 - protein, 4 aa, Artificial Sequence
  Description of Artificial Sequence: Synthetic peptide
GGGS

SEQ ID NO: 2031 - protein, 5 aa, Artificial Sequence
  Description of Artificial Sequence: Synthetic peptide
GGGGS

SEQ ID NO: 2032 - protein, 20 aa, Artificial Sequence
  Description of Artificial Sequence: Synthetic peptide
GGGGSGGGGSGGGGSGGGGS

SEQ ID NO: 2033 - protein, 15 aa, Artificial Sequence
  Description of Artificial Sequence: Synthetic peptide
GGGGSGGGGSGGGGS

SEQ ID NO: 2034 - protein, 60 aa, Artificial Sequence
  Description of Artificial Sequence: Synthetic polypeptide
  MISC_FEATURE (1)..(5): This region may encompass 1-5 residues
  MISC_FEATURE (7)..(11): This region may encompass 1-5 residues
  MISC_FEATURE (13)..(17): This region may encompass 1-5 residues
  MISC_FEATURE (19)..(23): This region may encompass 1-5 residues
  MISC_FEATURE (25)..(29): This region may encompass 1-5 residues
  MISC_FEATURE (31)..(35): This region may encompass 1-5 residues
  MISC_FEATURE (37)..(41): This region may encompass 1-5 residues
  MISC_FEATURE (43)..(47): This region may encompass 1-5 residues
  MISC_FEATURE (49)..(53): This region may encompass 1-5 residues
  MISC_FEATURE (55)..(59): This region may encompass 1-5 residues
  MISC_FEATURE (1)..(60): This sequence may encompass 1-10 "(Gly)x Ser" repeating units, wherein x = 1, 2, 3, 4 or 5
GGGGGSGGGGGSGGGGGSGGGGGSGGGGGSGGGGGSGGGGGSGGGGGSGGGGGSGGGGGS

SEQ ID NO: 2035 - protein, 6 aa, Artificial Sequence
  Description of Artificial Sequence: Synthetic peptide
GGGGGS

SEQ ID NO: 2036 - RNA, 5000 nt, Artificial Sequence
  Description of Artificial Sequence: Synthetic polynucleotide
  misc_feature (1)..(5000): This sequence may encompass 50-5000 nucleotides
  See specification as filed for detailed description of substitutions and preferred embodiments
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2037 - protein, 600 aa, Artificial Sequence
  Description of Artificial Sequence: Synthetic polypeptide
  MISC_FEATURE (1)..(5): This region may encompass 1-5 residues
  MISC_FEATURE (7)..(11): This region may encompass 1-5 residues
  MISC_FEATURE (13)..(17): This region may encompass 1-5 residues
  MISC_FEATURE (19)..(23): This region may encompass 1-5 residues
  MISC_FEATURE (25)..(29): This region may encompass 1-5 residues
  MISC_FEATURE (31)..(35): This region may encompass 1-5 residues
  MISC_FEATURE (37)..(41): This region may encompass 1-5 residues
  MISC_FEATURE (43)..(47): This region may encompass 1-5 residues
  MISC_FEATURE (49)..(53): This region may encompass 1-5 residues
  MISC_FEATURE (55)..(59): This region may encompass 1-5 residues
  MISC_FEATURE (61)..(65): This region may encompass 1-5 residues
  MISC_FEATURE (67)..(71): This region may encompass 1-5 residues
  MISC_FEATURE (73)..(77): This region may encompass 1-5 residues
  MISC_FEATURE (79)..(83): This region may encompass 1-5 residues
  MISC_FEATURE (85)..(89): This region may encompass 1-5 residues
  MISC_FEATURE (91)..(95): This region may encompass 1-5 residues
  MISC_FEATURE (97)..(101): This region may encompass 1-5 residues
  MISC_FEATURE (103)..(107): This region may encompass 1-5 residues
  MISC_FEATURE (109)..(113): This region may encompass 1-5 residues
  MISC_FEATURE (115)..(119): This region may encompass 1-5 residues
  MISC_FEATURE (121)..(125): This region may encompass 1-5 residues
  MISC_FEATURE (127)..(131): This region may encompass 1-5 residues
  MISC_FEATURE (133)..(137): This region may encompass 1-5 residues
  MISC_FEATURE (139)..(143): This region may encompass 1-5 residues
  MISC_FEATURE (145)..(149): This region may encompass 1-5 residues
  MISC_FEATURE (151)..(155): This region may encompass 1-5 residues
  MISC_FEATURE (157)..(161): This region may encompass 1-5 residues
  MISC_FEATURE (163)..(167): This region may encompass 1-5 residues
  MISC_FEATURE (169)..(173): This region may encompass 1-5 residues
  MISC_FEATURE (175)..(179): This region may encompass 1-5 residues
  MISC_FEATURE (181)..(185): This region may encompass 1-5 residues
  MISC_FEATURE (187)..(191): This region may encompass 1-5 residues
  MISC_FEATURE (193)..(197): This region may encompass 1-5 residues
  MISC_FEATURE (199)..(203): This region may encompass 1-5 residues
  MISC_FEATURE (205)..(209): This region may encompass 1-5 residues
  MISC_FEATURE (211)..(215): This region may encompass 1-5 residues
  MISC_FEATURE (217)..(221): This region may encompass 1-5 residues
  MISC_FEATURE (223)..(227): This region may encompass 1-5 residues
  MISC_FEATURE (229)..(233): This region may encompass 1-5 residues
  MISC_FEATURE (235)..(239): This region may encompass 1-5 residues
  MISC_FEATURE (241)..(245): This region may encompass 1-5 residues
  MISC_FEATURE (247)..(251): This region may encompass 1-5 residues
  MISC_FEATURE (253)..(257): This region may encompass 1-5 residues
  MISC_FEATURE (259)..(263): This region may encompass 1-5 residues
  MISC_FEATURE (265)..(269): This region may encompass 1-5 residues
  MISC_FEATURE (271)..(275): This region may encompass 1-5 residues
  MISC_FEATURE (277)..(281): This region may encompass 1-5 residues
  MISC_FEATURE (283)..(287): This region may encompass 1-5 residues
  MISC_FEATURE (289)..(293): This region may encompass 1-5 residues
  MISC_FEATURE (295)..(299): This region may encompass 1-5 residues
  MISC_FEATURE (301)..(305): This region may encompass 1-5 residues
  MISC_FEATURE (307)..(311): This region may encompass 1-5 residues
  MISC_FEATURE (313)..(317): This region may encompass 1-5 residues
  MISC_FEATURE (319)..(323): This region may encompass 1-5 residues
  MISC_FEATURE (325)..(329): This region may encompass 1-5 residues
  MISC_FEATURE (331)..(335): This region may encompass 1-5 residues
  MISC_FEATURE (337)..(341): This region may encompass 1-5 residues
  MISC_FEATURE (343)..(347): This region may encompass 1-5 residues
  MISC_FEATURE (349)..(353): This region may encompass 1-5 residues
  MISC_FEATURE (355)..(359): This region may encompass 1-5 residues
  MISC_FEATURE (361)..(365): This region may encompass 1-5 residues
  MISC_FEATURE (367)..(371): This region may encompass 1-5 residues
  MISC_FEATURE (373)..(377): This region may encompass 1-5 residues
  MISC_FEATURE (379)..(383): This region may encompass 1-5 residues
  MISC_FEATURE (385)..(389): This region may encompass 1-5 residues
  MISC_FEATURE (391)..(395): This region may encompass 1-5 residues
  MISC_FEATURE (397)..(401): This region may encompass 1-5 residues
  MISC_FEATURE (403)..(407): This region may encompass 1-5 residues
  MISC_FEATURE (409)..(413): This region may encompass 1-5 residues
  MISC_FEATURE (415)..(419): This region may encompass 1-5 residues
  MISC_FEATURE (421)..(425): This region may encompass 1-5 residues
  MISC_FEATURE (427)..(431): This region may encompass 1-5 residues
  MISC_FEATURE (433)..(437): This region may encompass 1-5 residues
  MISC_FEATURE (439)..(443): This region may encompass 1-5 residues
  MISC_FEATURE (445)..(449): This region may encompass 1-5 residues
  MISC_FEATURE (451)..(455): This region may encompass 1-5 residues
  MISC_FEATURE (457)..(461): This region may encompass 1-5 residues
  MISC_FEATURE (463)..(467): This region may encompass 1-5 residues
  MISC_FEATURE (469)..(473): This region may encompass 1-5 residues
  MISC_FEATURE (475)..(479): This region may encompass 1-5 residues
  MISC_FEATURE (481)..(485): This region may encompass 1-5 residues
  MISC_FEATURE (487)..(491): This region may encompass 1-5 residues
  MISC_FEATURE (493)..(497): This region may encompass 1-5 residues
  MISC_FEATURE (499)..(503): This region may encompass 1-5 residues
  MISC_FEATURE (505)..(509): This region may encompass 1-5 residues
  MISC_FEATURE (511)..(515): This region may encompass 1-5 residues
  MISC_FEATURE (517)..(521): This region may encompass 1-5 residues
  MISC_FEATURE (523)..(527): This region may encompass 1-5 residues
  MISC_FEATURE (529)..(533): This region may encompass 1-5 residues
  MISC_FEATURE (535)..(539): This region may encompass 1-5 residues
  MISC_FEATURE (541)..(545): This region may encompass 1-5 residues
  MISC_FEATURE (547)..(551): This region may encompass 1-5 residues
  MISC_FEATURE (553)..(557): This region may encompass 1-5 residues
  MISC_FEATURE (559)..(563): This region may encompass 1-5 residues
  MISC_FEATURE (565)..(569): This region may encompass 1-5 residues
  MISC_FEATURE (571)..(575): This region may encompass 1-5 residues
  MISC_FEATURE (577)..(581): This region may encompass 1-5 residues
  MISC_FEATURE (583)..(587): This region may encompass 1-5 residues
  MISC_FEATURE (589)..(593): This region may encompass 1-5 residues
  MISC_FEATURE (595)..(599): This region may encompass 1-5 residues
  MISC_FEATURE (1)..(600): This sequence may encompass 1-100 "(Gly)x Ser" repeating units, wherein x = 1, 2, 3, 4 or 5
GGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGSGGGGGS

SEQ ID NO: 2038 - protein, 6 aa, Artificial Sequence
  Description of Artificial Sequence: Synthetic peptide
VTYARL

SEQ ID NO: 2039 - protein, 6 aa, Artificial Sequence
  Description of Artificial Sequence: Synthetic peptide
VVYYRV

SEQ ID NO: 2040 - protein, 6 aa, Artificial Sequence
  Description of Artificial Sequence: Synthetic peptide
LIYSQV

SEQ ID NO: 2041 - protein, 6 aa, Artificial Sequence
  Description of Artificial Sequence: Synthetic peptide
  MOD_RES (2)..(2): His or Gln
  MOD_RES (5)..(5): Val or Ser
LXYAXL

SEQ ID NO: 2042 - protein, 10 aa, Artificial Sequence
  Description of Artificial Sequence: Synthetic peptide
GGGGSGGGGS

SEQ ID NO: 2043 - DNA, 30 bp, Artificial Sequence
  Description of Artificial Sequence: Synthetic oligonucleotide
ggtggcggaggttctggaggtggaggttcc

SEQ ID NO: 2044 - protein, 400 aa, Artificial Sequence
  Description of Artificial Sequence: Synthetic polypeptide
  MISC_FEATURE (1)..(400): This sequence may encompass 1-100 "Gly Gly Gly Ser" repeating units
  See specification as filed for detailed description of substitutions and preferred embodiments
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 2045 - protein, 500 aa, Artificial Sequence
  Description of Artificial Sequence: Synthetic polypeptide
  MISC_FEATURE (1)..(500): This sequence may encompass 1-100 "Gly Gly Gly Gly Ser" repeating units
  See specification as filed for detailed description of substitutions and preferred embodiments
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 2046 - protein, 8 aa, Artificial Sequence
  Description of Artificial Sequence: Synthetic peptide
SCDLLTAF

SEQ ID NO: 2047 - protein, 6 aa, Artificial Sequence
  Description of Artificial Sequence: Synthetic peptide
IQYTEL

SEQ ID NO: 2048 - RNA, 2000 nt, Artificial Sequence
  Description of Artificial Sequence: Synthetic polynucleotide
  misc_feature (1)..(2000): This sequence may encompass 50-2000 nucleotides
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2049 - protein, 6 aa, Artificial Sequence
  Description of Artificial Sequence: Synthetic peptide
  MOD_RES (2)..(2): Any amino acid
  MOD_RES (4)..(4): Any amino acid
  MOD_RES (5)..(5): Any amino acid
  MOD_RES (6)..(6): Val or Ile
TXYXXX

SEQ ID NO: 2050 - protein, 6 aa, Artificial Sequence
  Description of Artificial Sequence: Synthetic peptide
  MOD_RES (1)..(1): Ser, Val, Ile, or Leu
  MOD_RES (2)..(2): Any amino acid
  MOD_RES (4)..(4): Any amino acid
  MOD_RES (5)..(5): Any amino acid
  MOD_RES (6)..(6): Val, Ile, or Leu
XXYXXX

It is claimed:

1. A chimeric antigen receptor (CAR) comprising an extracellular domain comprising an antigen binding domain, a transmembrane domain, and an intracellular domain, wherein:
   (a) the intracellular domain comprises an Immunoreceptor Tyrosine-based Switch Motif (ITSM), wherein said ITSM is a sequence of amino acids $TX_1YX_2X_3X_4$ (SEQ ID NO: 2049), wherein
   $X_1$ is E;
   $X_2$ is A or S;
   $X_3$ is S or E; and
   $X_4$ is V or I; and
   (b) the intracellular domain has at least 95% amino acid sequence identity with SEQ ID NO: 2016.

2. The CAR according to claim 1, wherein said ITSM is selected from the group consisting of TEYASI (SEQ ID NO: 936), TEYSEI (SEQ ID NO: 940), and TEYSEV (SEQ ID NO: 941).

3. The CAR according to claim 1, wherein the antigen binding domain is a single chain variable fragment (scFv).

4. The CAR according to claim 1, wherein the intracellular domain is selected from the group consisting of SEQ ID NO: 2014, SEQ ID NO: 2015, and SEQ ID NO: 2016.

5. The CAR according to claim 1, wherein the antigen binding domain binds to PSMA, ITGAX, CD1E, CD34, CD1C, CD123, CD141, ZP2, GABRA6, CRTAM, GRM4, MDGA1, ZP2, GABRA6, CRTAM, GRM4, MDGA1, SFTPC, ROS1, SLC6A4, AGTR2, LRRC26, HTR3A, TMEM211, MRGPRX3, MEP1B, TMIGD1, CEACAM20, ALPI, TMPRSS11B, CYP17A1, ATP4B, GP2, MUC21, CLCA4 or SLC27A6.

6. The CAR according to claim 1, wherein the transmembrane domain comprises the transmembrane region(s) of the alpha, beta or zeta chain of the T-cell receptor, PD-1, 4-1BB, OX40, ICOS, CTLA-4, LAG3, 2B4, BTLA4, TIM-3, TIGIT, SIRPA, CD28, CD3 epsilon, CD45, CD4, CD5, CD8, CD9, CD16, CD22, CD33, CD37, CD64, CD80, CD86, CD134, CD137 or CD154.

7. The CAR according to claim 1, wherein the transmembrane domain comprises the transmembrane region of PD-1 or CD8 alpha.

8. The CAR according to claim 1, wherein the transmembrane domain is attached to the extracellular domain of the CAR via a hinge.

9. The CAR according to claim 8, wherein the hinge is an IgG4 hinge, a CD8 alpha hinge or a PD-1 hinge.

10. The CAR according to claim 1, wherein said ITSM is TEYASI (SEQ ID NO: 936).

11. The CAR according to claim 1, wherein said ITSM is TEYSEI (SEQ ID NO: 940).

12. The CAR according to claim 1, wherein said ITSM is TEYSEV (SEQ ID NO: 941).

13. The CAR according to claim 10, wherein the intracellular domain is PD1 (ITSM mut3) (SEQ ID NO: 2016).

14. The CAR according to claim 11, wherein the intracellular domain is PD1 (ITSM mut1) (SEQ ID NO: 2014).

15. The CAR according to claim 12, wherein the intracellular domain is PD1 (ITSM mut2) (SEQ ID NO: 2015).

16. An isolated immune cell, comprising:
   a first CAR comprising an extracellular domain comprising an antigen binding domain, a transmembrane domain, and an intracellular domain; and
   a second CAR, wherein the second CAR is a CAR according to claim 1.

17. The immune cell according to claim 16, wherein:
   the antigen to which the antigen binding domain of the first CAR binds is CD33 and the antigen to which the antigen binding domain of the second CAR binds is ITGAX, CD1E, CD34, CD1C, CD123, or CD141, or,
   the antigen to which the antigen binding domain of the first CAR binds is FLT3 and the antigen to which the antigen binding domain of the second CAR binds is ZP2, GABRA6, CRTAM, GRM4 or MDGA1, or,
   the antigen to which the antigen binding domain of the first CAR binds is MSLN and the antigen to which the antigen binding domain of the second CAR binds is SFTPC, ROS1, SLC6A4 or AGTR2, or,
   the antigen to which the antigen binding domain of the first CAR binds is MUC16 and the antigen to which the antigen binding domain of the second CAR binds is LRRC26, HTR3A, TMEM211 or MRGPRX3, or,
   the antigen to which the antigen binding domain of the first CAR binds is MUC17 and the antigen to which the antigen binding domain of the second CAR binds is MEP1B, TMIGD1, CEACAM20 or ALPI, or,
   the antigen to which the antigen binding domain of the first CAR binds is present in tumor cells of pancreatic ductal adenocarcinoma and the antigen to which the antigen binding domain of the second CAR binds is TMPRSS11B, CYP17A1 or ATP4B,
   the antigen to which the antigen binding domain of the first CAR binds is present in tumor cells of kidney clear cell carcinoma and the antigen to which the antigen binding domain of the second CAR binds is GP2, MUC21, CLCA4 and SLC27A6.

18. The immune cell according to claim 16, wherein the immune cell is a human T-cell.

19. A method of engineering an immune cell according to claim 16 comprising: (a) providing an immune cell; and (b) expressing the second CAR and the first CAR at the surface of said cells.

20. A polynucleotide comprising a nucleic acid sequence encoding a CAR according to claim 1.

21. A vector comprising a polynucleotide according to claim 20.

* * * * *